United States Patent 12,577,609 (METHODS FOR CELL-TYPE SPECIFIC PROFILING TO IDENTIFY DRUG TARGETS) - sequence listing, part 10

SEQ ID NO: 12356 - DNA, 5707 bp, Homo sapiens
  ENST00000288745
gcccgctgcccgccgcccggctcccggctgctcgcggccccctgctcctgcctggcgctctggccaggctcgggctccggaggacaggaccgcgcgactggccggccgatccctgggccggccgcgggagcagctatgctgtgactgtccaggaatcgtatgcacaccccttcgatcagatctattacacacgatgcacagacatcctcaactggttcaagtgcaccaggcaccgccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaattt

SEQ ID NO: 12357 - DNA, 3423 bp, Homo sapiens
  ENST00000395614
atggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcagatttgtctcaaagtagcagccatgcccactgcttttccaattccagctaccacgcactggcatgtggggggcctgccaccagccaggccagcactctggacaggaacagccccaccaagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaa

SEQ ID NO: 12358 - DNA, 909 bp, Homo sapiens
  ENST00000478721
tagtcacatagggactcaggaatcgggccaaagccagaaccagatctcctaacattagaggggttacacgcatctgaacccaggcccaggagacctgaagcgcaagaaggccagccccaggctcaggccctccctctgcccgcagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcagcatcaaccacaccatggtggcctgtcatggaacacctagctcgccctttctctcaacggcctaggacccagctcagtaacaagtcccttgacagagacacagcaggctggaccccctacagctatgtgaacgtgttagatcagtgccctggaggccaggtacccgcccgaggacttctacattgaacttagacacctcagccgccccgctgagccacactcaccaggtgcttgtggaatggatagacgtcagaacacatacattatggacaaaggcttcaaaggcaggtggatgactcagctggagaacaaagtggcttcctgagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatga

SEQ ID NO: 12359 - DNA, 3216 bp, Homo sapiens
  ENST00000490495
ggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgtaagccccacctcctggcctcccagccacttagaataccatgctgcggcctactggccactgtgggcattgtccagaccagcagggagggaggaatgcaggcagccccaggactggtggtacctgactcctgccccacgagaactgaggagctctgcaggggcagctccagacctgactggattcaggggattgacaagcccaaagtcctggaaggtcagggctgcaaggctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccagataagccttggatccaggagaggacagacaggaccagagctgagaggtgcttgtggaatggatagacgtcagaacacatacattatggacaaaggcttcaaaggcaggtggatgactcagctggagaacaaagtggcttcctgaggtggagtttccagcttgcccagcccttccccattctccagtcccagtagagatggggtacagaagagtccataattcaacacccttttctcaccacccagccaacacatacatgcactgctccatcctctgctcctgtatggaagatacttccccctgagcttagcccctccccacagacatcaacttctcttttatccatttaggatcatcccctgctccagagccaacaattgattccccaaaactttaaagtagccccgacttttctggtgaaaatgagaagaggcactatcaactggccgaggttcttttaggcattgaacttcaaggctctcctactgccctaactcagtcatgggatatccacaaaaaacttaagagcttagcctttttctctcagctgggcttagccccatagatgaaagacattccttgttaagggtaaggtgtagctgctgcagatacagtttgcctttagagatatggacaggagccctggataacaagacacgtagtgagggaaaacatcttgattggtatcaagagaagacaggggttgagtcctgactaaactatttactaacattaggaattatattagcaaattttctgagcttcagattcctcattctaaagtagaaacaacagtcctttctgcccagccctattcacgatgtaacaagtttcaaatgacctaattggaatgaagactatacgtgcta

SEQ ID NO: 12360 - DNA, 733 bp, Homo sapiens
  ENST00000489275
atttgtctcaaagtagcagccatgcccactgcttttccaattccagctaccacgcactggcatgtggggggcctgccaccagccaggccagcactctggacaggaacagccccaccaagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccagataagccttggatccaggagaggacagacaggaccagagctgagaggtgcttgtggaatggatagacgtcagaacacatacattatggacaaaggcttcaaaggcaggtggatgactcagctggagaacaaagtggcttcctgaggtggagtttccagcttgcccagcccttccccattctccagtcccagtagagatggggtacagaagagtccataattcaacacccttttctcaccacccagccaacacatacatgcactgctccatcctctgctcctgtatggaagatacttccccctgagcttagcccctccccacagacatcaacttctcttttatccatttaggatcatcccctgctccagagccaacaattgattccccaaaactttaaagtagccccgacttttctggtgaaaatgagaagaggcactatcaactg

SEQ ID NO: 12361 - DNA, 740 bp, Homo sapiens
  ENST00000562154
ctggaccccctacagctatgtgaacgtgttagatcagtgccctggaggccaggtacccgcccgaggacttctacattgaacttagacacctcagccgccccgctgagccacactcaccaggtgcttgtggaatggatagacgtcagaacacatacattatggacaaaggcttcaaagatgccaactaaatgtcttcggaaatgtaaagcgtcattatccaaccaattagtacgagttaaattgattataaaatctgaaataaagttgatctacctgccccagaggcctcctgtcgttgcactagcaaggaatgccaccctgcacctgctggctttctgggggcacaaggaatgaaaatgatacgcagtgttaatattgtatggcactccaacctcaagagatctctgcctccaagagcagagaagccaagacaaatccctaacacatgggaactgcaagttggatcatccctctaggaagtctacaggtgaagccaaagatgaaaggtcaggtcctgccctaggtttaaatgccggaatgtgtgaaatagggggctttggaactctgtcacttgccactctgttgctcattaactgtgaccttagactggactgtgagctttccaaggctcagtttcctcatctgcaaggttgggataattttgcctgtcctattgtctaatgcctgtcctactgtctaacaaggttatcatgagtaaccaataaaatcaccaatgggaa

SEQ ID NO: 12362 - DNA, 524 bp, Homo sapiens
  ENST00000493192
ccccatccaggctccagttgatagtgcctccccttggcacagatttgtctcaaagtagcagccatgcccactgcttttccaattccagctaccacgcactggcatgtggggggcctgccaccagccaggccagcactctggacaggaacagccccaccaagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccagataagccttggatccaggagaggacagacaggaccagagctgagaggtgcttgtggaatggatagacgtcagaacacatacattatggacaaaggcttcaaagttgcacctgcttagcaaatgcttgtgggttttttatagatgccaactaaatgtcttcggaaatgtaaagcgtcattatccaaccaattagt

SEQ ID NO: 12363 - DNA, 577 bp, Homo sapiens
  ENST00000478590
gatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtaagggccatgctcctggcctccctcctcttcccctccacacacacataccccaggaatggttgtgcctgtagggttggctgctgtggctgaatgtggaagctcagtctcccctagagtgacagtggggatggggagcaggagcctacctagagaagatatctggggttccaagggaaaattgtttcctgagtccctagctctgagcagc

SEQ ID NO: 12364 - DNA, 454 bp, Homo sapiens
  ENST00000564573
gtgcctcccaggattctctggagctctctgcaaccaagctagcaagtggcagaaacaaattctgattccgacatgcatgctgaagggatgaaaagtgaaacaagcacagagatctgcatcagaagtggcaccatgtggtctgtgccgagtgccaagggtaaaggcagagaatgctgtgggagtgcagaggagctggctctggctggagatggcaacttccaagcccttctccccgtcatattcaggccaccatccctaatccctccccatatgctttcctgacttgacctcagaatccttcacaataccgactccaagaactgctaccactcagcaggagttgaaaagagatataaagcttatttgcattggtgttccaccctaccagctctttgtgggggaaaaaccctgatctgtaacatctgcagatttttaaaatataaatattcctacc

SEQ ID NO: 12365 - DNA, 864 bp, Homo sapiens
  ENST00000455812
tgcttttccatcttccagtgtgtgacatcctttgtctcctattcctcttttctttggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgccc

SEQ ID NO: 12366 - DNA, 333 bp, Homo sapiens
  ENST00000484618
ctcctccacctgcttttccatcttccaggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggccca

SEQ ID NO: 12367 - DNA, 760 bp, Homo sapiens
  ENST00000474398
agttatcactcctccacctgcttttccatcttccagtgtgtgacatcctttgtctcctattcctcttttctttgtgggtttatacctgtacccctttgactctcatgtcagctgggtttgagaaagaagctgagcaaagtgcacgtctccataccagcatgtttactcagcctccttccttatgtcttctcagcactttactgtgtacccatgtgagagtacttactgccttgtacttagcggtttttttggctctttctgtggtagactaggaggacaggaatcaaatcgaatcacccctagtgtctcacacagcacctcgtatacaataggcagttcctaaattgtgctgaataactggatgagcaagttggcctcagtctcccatctcccatctctaagaggagggctttggagccctggtgtccagctgtctgaacttcttctgggaagttgggtggtccctggagccacagcaggtgtgccattcccaggaaagtttggcatttctggagcaccgccatgcatgtcttcccacctttcttttagggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggc

SEQ ID NO: 12368 - DNA, 472 bp, Homo sapiens
  ENST00000469917
attgcccaggaagcagaaaccaaagcagttatcactcctccacctgcttttccatcttccaggagcagtgtgtgcccagccctgcccaccagggacatttggccagaactgcagccaggattgtccttgccaccatggagggcagtgtgaccacgtgactggacagtgccactgtacagctggatacatgggggacagaacccgatgaggtttagtgagtatcgtcccattttatgaaaaagaagaggatgtcagagctttaggcttggaatcaataaaatatggtggtacaaactcattgctggggggactgagccgacctggcatgaaaggcagaaatgactggggcgaactaaaccatggactacttcctggaggaggagagagaaaaggggaggaggctgtgagcagcgtggagcacaccaggcctgggccagatggccaggaggaccacatcctggaggatcttgaa

SEQ ID NO: 12369 - DNA, 5914 bp, Homo sapiens
  ENST00000422354
gcccgctgcccgccgcccggctcccggctgctcgcggccccctgctcctgcctggcgctctggccaggctcgggctccggaggacaggaccgcgcgactggccggccgatccctgggccggccgcgggagcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaattt

SEQ ID NO: 12370 - DNA, 292 bp, Homo sapiens
  ENST00000615799
atttgtctcaaagtagcagccatgcccactgcttttccaattccagctaccacgcactggcatgtggggggcctgccaccagccaggccagcactctggacaggaacagccccaccaagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccaggtca

SEQ ID NO: 12371 - DNA, 120 bp, Homo sapiens
  ENST00000612969
ctggaccccctacagctatgtgaacgtgttagatcagtgccctggaggccaggtacccgcccgaggacttctacattgaacttagacacctcagccgccccgctgagccacactcaccag

SEQ ID NO: 12372 - DNA, 330 bp, Homo sapiens
  ENST00000618218
ccccatccaggctccagttgatagtgcctccccttggcacagatttgtctcaaagtagcagccatgcccactgcttttccaattccagctaccacgcactggcatgtggggggcctgccaccagccaggccagcactctggacaggaacagccccaccaagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccag

SEQ ID NO: 12373 - DNA, 608 bp, Homo sapiens
  ENST00000617841
tagtcacatagggactcaggaatcgggccaaagccagaaccagatctcctaacattagaggggttacacgcatctgaacccaggcccaggagacctgaagcgcaagaaggccagccccaggctcaggccctccctctgcccgcagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcagcatcaaccacaccatggtggcctgtcatggaacacctagctcgccctttctctcaacggcctaggacccagctcagtaacaagtcccttgacagagacacagcaggctggaccccctacagctatgtgaacgtgttagatcagtgccctggaggccaggtacccgcccgaggacttctacattgaacttagacacctcagccgccccgctgagccacactcaccag

SEQ ID NO: 12374 - DNA, 2347 bp, Homo sapiens
  ENST00000614417
ggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgtaagccccacctcctggcctcccagccacttagaataccatgctgcggcctactggccactgtgggcattgtccagaccagcagggagggaggaatgcaggcagccccaggactggtggtacctgactcctgccccacgagaactgaggagctctgcaggggcagctccagacctgactggattcaggggattgacaagcccaaagtcctggaaggtcagggctgcaaggctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcagctcagtaacaagtcccttgacagagacacagcaggctggaccccctacagctatgtgaacgtgttagactcccatttccagatcagtgccctggaggccaggtacccgcccgaggacttctacattgaacttagacacctcagccgccccgctgagccacactcaccag

SEQ ID NO: 12375 - DNA, 577 bp, Homo sapiens; identical to SEQ ID NO: 12363
  ENST00000621793

SEQ ID NO: 12376 - DNA, 2644 bp, Homo sapiens
  ENST00000615866
gcccgctgcccgccgcccggctcccggctgctcgcggccccctgctcctgcctggcgctctggccaggctcgggctccggaggacaggaccgcgcgactggccggccgatccctgggccggccgcgggagcagctatgctgtgactgtccaggaatcgtatgcacaccccttcgatcagatctattacacacgatgcacagacatcctcaactggttcaagtgcaccaggcaccgccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcag

SEQ ID NO: 12377 - DNA, 2883 bp, Homo sapiens
  ENST00000614717
cgctcccggtgcccgctgcccgccgcccggctcccggctgctcgcggccccctgctcctgcctggcgctctggccaggctcgggctccggaggacaggaccgcgcgactggccggccgatccctgggccggccgcgggagcagcctcctttgttctcctgtgcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcag

SEQ ID NO: 12378 - DNA, 454 bp, Homo sapiens; identical to SEQ ID NO: 12364
  ENST00000622356

SEQ ID NO: 12379 - DNA, 864 bp, Homo sapiens; identical to SEQ ID NO: 12365
  ENST00000613422

SEQ ID NO: 12380 - DNA, 333 bp, Homo sapiens; identical to SEQ ID NO: 12366
  ENST00000614563

SEQ ID NO: 12381 - DNA, 760 bp, Homo sapiens; identical to SEQ ID NO: 12367
  ENST00000620966

SEQ ID NO: 12382 - DNA, 472 bp, Homo sapiens; identical to SEQ ID NO: 12368
  ENST00000614471

SEQ ID NO: 12383 - DNA, 4800 bp, Homo sapiens
  ENST00000602452
ggacaaaagccaggatggatgttcaaaaatggtatttgagaacttcaaagctggctctggccttggcaattatccgctcaaaaccagcagacaaaagcagcagagaatacacagagcaccttgctatgttgctgtctgaggagcagtcaaaatggagatcaaaagttgaaatcttggaagctgaagttatgcaattacgtcaaaaacttcttgtgagcaggctttgttcaggatcctttaagagtggatacgtttcctcccagttggaggctcaggaacctaagagttctgaaagtacattaacttcgatggaagattctggatgtgatttgtcgaatgagcagagaactgaatcctcagacctgtcccagcactttgtggaaagctgtacccccactcactttccaccactgcctcttgtgaaaagaccttgtgctatcctgcaaaatcctttgtcttctcacatgcaattcttgcaatatctacttgaattaaagaacttgacagaatcaggtaatcttaaaagagacttaacccactttgaaaaagactcttccacagtctctgattctgtttttcaattgctggatggcctgatcactttttaccgtaatcccaaacttcctttttcaagattttggacagaagctgttggtactttagctagtctgatcagtgactataacttatctagtcatattcttaaaaagtgttccaagaagttggaagaatttgagaaaaccctactacatgctattttaggaaacaatcatataaatcagtttcaggtgcagcattatgtctctcagagtctggttaccttgggaaattgcagcttgttgagaaaatctattatatctctgcttctatcagaagtaaatggctttgctgatgatctgggagccatcaatcaggagcaagccagttatgatgtgtcacgctatgaaaacattttctacctgttctgggttctggagcagcttcttcaaaaggaaaccgaagaaggcaacacttcaagtataggtcatgatgaccaagaaatcaagaaatttcttcagaagcatgatgaaactattttccaactttctgatgcatttcctttgtttactttttatttatggagagtgggcattcttttgagctcagcacagatagaaactcttagaaaataactccattccttagcaatttaccacgtttgaagcataataaagtagaatatatgaaaatctcatactgaaaagattttcaatagtattttaattagcattttagaattgatctctaaatataattatcaattcaacttaatggttagtcttaaattgtatgaaattttatgagtcatatttctatactaaaatcagccagtttcggttggtaatgccatccttattcccatgtaactgtatcttatttcactcaatatagtttagctctattattctgtaaaatggaccattaattgtctgtcccttaaaagatattgaagttgtaaaagatttccatataattgatgctaaatggtaatcaaagaaagagatttttaaagaagtttagttgcattatcaacacaaagtgttggaatataagaagtggtcataaatgcaatttttaaaactttttcttacatagttgaacttatatcattgctttcaccttagacgagaatcatatagaagtagaacttttttaacatttggaaacttaattgctttttatttatttcaatttcatatggctaatacatttgtcgagctcttttgaaaatactattaattagttgtttaaaatgttctttgtttttcaacaaatacttgtttcaattctgttaattaaatatgttataatagtcttgtaattgttaaatagtatacaattaagtcactagacatattttataaattctaatatccatctaaaagtgaaatttatagttatttggtggaatttttcagttatacaatttcattgacttcatttcaatgattaaaatcataaccgcaaacttaatgagcatatgttacatttcctatagtgccatttagggaacacaaaatataaatttcctttattaatgatatgtgatggtgtttcataagttaattagcattcctaaatgtcgttggcattaaaagtaatcttgataattccatctacaatgtatatacaattatgtcatctggcacaaacaattatctttggaattatttctagcatttttgaaaagataatgcctttttgataatcctgaaactacatgtatgtcagtcagcttttgttatgtgacagatagataatcaatcacaaaatatctatcagtggcatacaacaataatatttctcagatatatgcaggtcactcaaggatcagctgatttggactggacttgactttaatgaaaagctctgctgaggttgcacataccacaggaataggcttcttgctaaaagtcaggctttcttctcttccacatgtgcatattctgagaaccagacttgggggatagtagcttctcagtggaagctcctctcatggcagtggcaattgagcaagacgaaaggctaggctgagaaatgtcacattagcacttccatccacatgcattgtcaaagtacatcaaatggtcaagcccaaagaaaagtgactgacaggggagtagacttgagtgggagaacttgcagttacagggcaatgagcatggatgtaggtaggtaattattagggccaataatttacttcacaacaagtaccagttgaatacaagaagtatattccaaatcttggattaggagggatttttctaatgtctgattcctgtgaacacctgtgaaggcttatggaagtcacttcagttgatatagcattacacaaaatccactttccatgacaccttcatcttctttcattgtgattaaacaagattggtaaatacacaagtatcagcaatggccctttccctattgcagccagccaacgtaatgatcagctaagagacttttggagctacaacaaatttattaatttcagtggtctccaaggcttcaaggtctgaaaattagcctaggaaatatatttattataaaagaagatgcaagatgttgggatcactgtgaatgcacaaaatggagaaacattttatttccatttggtatccattttatataaacatttaacttccaccaagtatatgatactttaattatcctgggtttcagtctatatcagagtgaatggtgtagtaaattagtattaaggtccaaatctactggtcaaaaagaagataaaatgataaaatgagacatttttatctgtgtttcagtaaagcagtgaattaatgaatgatttaaactggtattacaatgtttaagaatgttataacagtttatatttaggtaatgtctaactttagaattaaggttttagggataagagtaatggagtcagtagtaattgggcagcattgaaactggatataagataggataggaaataaagagaaccatagaatgatcataaaaatgaagcaaataaaaagtgatgataattgctataactcttatactatttaatataagctataataaatatatgataatatattttatatgagagtaaatatatattaaatattttatatacatttatataataaaatatatgaataagtaatattatacatatatatacgatatgtataataaataccaaatagccaggtacttacctaagcattttacatatattaaactgtttgattctcccagcacctgtaatgagaaaggtacgattatttcctgaatctgtattttagagatgaagaactcagaacttgcccaagttcacaacaccaggaagtggcagttaggtttcatcctgaggcagtccatcttccaattccacactcctactttactgcactgcctgttatgtgcagctctcctggcacttcagtaaactttcacaaacacagcttctttgcaattgtcatcaaagctttatacatgcttaactatgaaccttaaggcacaacagtggaaattactagcttatgattagcttattttggattttttaattgctgtaaacaagttgtcctatctataagtaaaccagaggaacagcatctttgaccttttcagggttgtagcatcttgctactcaagactgtagccaagttacagattgtcttcaaacgataatgtcctaaaaggtacagagctccctccagaggtgtttaggtagactgtgaggctgtaatgataagcaaaatggggagagaaaacaaatctgactggtttgttcttggaaaaatatatacgattatctcacaggccttgtactttttaatggtatttgttgtcttttagccaaggtcagcatatttcaagagaggcagggaaacaaggcatttgcatttccaaaattttatgtacatttacagattttctgaacgccatattatggggaaaatattgacagctctgctttattgtaacctaatttcatttattcatcaaatatgaagcaccaattgtctacaaaccaattatttgcaaaaataaaacatactaagctttaacttttgtcagatttatgaaaccaagctttctcttagcagtcaatataatgacccaactacatcaatatttgctgaaggagataattaacttgttaatgtttatctaatattgaaaaaatatataggattttattattgttaaaagttaattgattccgaattatttatagaattgtataatacaaaatttatctggttaataaatatactggtcttg

SEQ ID NO: 12384 - DNA, 468 bp, Homo sapiens
  ENST00000496248
ccctgctgatcgattatttgataattgattttccccgcagccaatgcgcggcggcctgggcgggggcgcctcctgattggccgagcactcctccacggctgcctaccgagatttggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatag

SEQ ID NO: 12385 - DNA, 2773 bp, Homo sapiens
  ENST00000560281
cggaatccacctctccgcctgtgcaacacacactttacacacgcacggggactgcaagcgggcagcatcgatcgtggctcctttaagacaaactcagacagacattttttttaaccctccttctctaatctccttccagtgcagcacttgcaaagagggagagagagggagagaaagaaagagagagagagaagagagaaactgattaggaattaggactgattcaagggaagcgagcgctagggctttgtgcatttgaatattaacatttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcaggcaagtcccccatagtgactgtattcaagtcacgcaagcgaaaaccatcctcaagccattcaccgggaggtccgctacctggtaaataaactgggagtgagtataggaacgcctggcaattaaaattaaaccagtttcgtttcataacaacactaatcaatttaacatcattataaaacgtttggagaaggtggaaaaaaaaagccaacagagaaaagtaactcttaaataatatgctcagttacaatattctttgtacacattcaatatattaatgttattttttttctgagtttgccttcccagctctttctgctactatgaccactccctggtgcatggcttggtgtggaattgctgtaaactttattacctgtcaaaagggcaaaggggtcaggattgcttgtgggactcagtaaagttcaaagacattcaatgaggtagagcttttgtgtgctttaataacccaaggcagcttacttctgaagcagcttttcatgtacagttaaaacacgggattcaggtagtggtataaatacatggttcttatttctcagaccttctcttgttaatatccatcttctggtgttcgactttttttttttttaataacagtctttttgttttgtttttaaattatgagcttaaaatggcgatacttctatgggatcctggcttgtggatctaaaaatccaagaaacatctctctaggatttgtttttgcattataatatgccagtaagataacaagagtatttgctaggggtgatgtgagtctttactttctttatgaaatactctctcatctcttagggagcactatggaaaactatgttagcatcgcattgaggcaacacacatttactcctgtaactttttttcttccaacacccattatgtggtcaccagacaaaacccaagcagaaagtttccacaccttaactgttccctctttgagctagatgttttaaaaactcagtcacagaggtgtgtagatctagtctgagagaaatttcactttgaat

SEQ ID NO: 12386 - DNA, 1900 bp, Homo sapiens
  ENST00000491706
acacacgcacggggactgcaagcgggcagcatcgatcgtggctcctttaagacaaactcagacagacattttttttaaccctccttctctaatctccttccagtgcagcacttgcaaagagggagagagagggagagaaagaaagagagagagagaagagagaaactgattaggaattaggactgattcaagggaagcgagcgctagggctttgtgcatttgaatattaacatttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccaggtatgcgcttttcaatttcaacatccctgggaaaaaaaaaaatctgtatgcatattgcttgctgggtcactaccacctccttttattatttgcatatgattaagtcccttttagatacatttccatcgaaatgaaaatttttgaataatgtggctattattgcttcattaaggctggctctgggattcgacctgaagagatgagcttgtaaaagctttgctagcaaacttgacctgtttcttgtcgcttttaatttttgtctttattttatttaccctctataataatgggagtgttaactgccagtgaccgcctctgattgtaggggctttgttccggagcatttttcccccttctatcttcaagaaaagacaagtgtagggtctgcttatttcttattttattaggaataaatccaagataggtggtctaagaaagacagcgagagtttgaaatctagcaaatgctggctattttctccctgtctgtacggttcattagcctgtcttgtcagttttcctcggccgaacgcttctagacctcactgaacattgctttgtgtggtgttcactgcaagctcacccattttattgtacttaatagaaaaaataagaccaggccgaggttataaaaacagataaatatggacttttctcctccttctttccactcatcctccagctggtatgtgctctgggccctctgggttggcagcttgtggaca

SEQ ID NO: 12387 - DNA, 4291 bp, Homo sapiens
  ENST00000272369
atttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcatgctgactccactgcttgaaaaatttgtttactgccccccagatttttaaagattaatacagtaaatataaaaattaattttggctccctaagccatatatgtatttgacaattttaaccgcaaagtaagttgtttaataataaccactgatttctttaagctgacttaatgaactcctaatatcagcaaatttgaggcctaaaggcactaaactaactctagactcagaattacatccaacagaattactcatctaatatcagtgaaattattcttgcacataaaggcaaacctaagtacaaagttaagtcttttactaaaggatgttacctaggatgagcagtatatgtttattaggaaattaactacatgaattgaagagaccagacttcaaaatctaatttttataaatatgctctatgttctcattggataaaactggttattaaccaattttccagaacagctgtacaagatttctgcatggcagccggctaaatggtagaaaataatatgtttaagctggaatagcttataattttatttaaataaaattgctgctataaaaagtgcttcccaaagctaaggaaaatatacaaatattttaattaaggcaaattcgttttaaaaaataagcctttcagtagtgattgctttgtaaacaaaggatgggtcggaggagagagagccttaaactcaagtctgacattcaggcccaagtcaccctataaaccggcccttagcaattctattttctattcgaaaagagaaaccagctgtgggttggctttactaggtgatgtgtgattgactgactcacctgctggagtagcaatgcattctcaccttttgctgatggggccttgtttctaaacacgtggatgcgcagagagcaaggctcagcctactgcagccatctctggcagcgcttctacccctccccagcccatagatgggattgtttaaatctcccttgttgacctagtggcaattcttcctctacctaaatagtcgatgtgagtgaaatcattctcttttgataggtggttgctagcagttaacaaccatttatttactttaacaattaataataaactttataaactgtc

SEQ ID NO: 12388 - DNA, 5111 bp, Homo sapiens
  ENST00000488550
ctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggtaagactttgtttttgtggtagttcctcatttttgactccaagagtgtcatcccctcatcaacacaggtaaatccgcctcatccttttctgttatctcaagctggctgccttgccttgtctgctatctgtgcatctaagatattgcagaggggaagccaggatctttatgcactgaagatctcactatttctcaaccctctagatcctgttttttttttaagggtcttttggcactatctgttgactttgctcattttctggcctcttcttggatttttatctcccttctaggacctatgagtggaatgggcatgaatatgggcatggaggggcagtggcactacatgtaaccttcatctagttaaccaatcgcaaagcaagggggaagtaagtacaaatggggtctttgttttcactttgtcctaggaatatttttcctcttgcattttcttatgttctccttgcccatagcttcatgcttgttcattcctttccattaaactcctggtttcttgcttccatcattttctttttggttgtgatcaagcttttaagcttataaatactgtgtatgatgtacatttatcctgtgtgttgctattgtacagtactgaccacatgacaaaacaagaagcagtcaggaggtgggggagtgggttgtcatagcaacagactgatttgcaaaatgtaagcagtctgcagcagtgcaaggagagggaagagcatgtccccaaagtgtcataaatctgtctaaccgcagttgatgcatgagttacatttctacactaacctgcaagacaccgaaaagctaaacagagacttcttttaggtaaaataaacacaagctttacttagggtaagtaaaggcatattttgagctccagtcaactaaactttgattttttttcttagtttattcctttgtctgtccatcataatgggattacgtgtggcaatgggaaaagggagaatacaaaatagaggtgtgcacagcaggctgcggggcttagcccaggctaattgactatatccaaattaagtatgccatcacttgcagtgtgacaaatggatttgacttattcagtatacaaaaatagagatcattaatgcaatcatcagtggcaggcctagtgaagtgggcctaggaaaactgtcccagattctcactcttgcattttctctcctataaagacactccagcaattcgagttcaaacaagtaaaactgttttgaacaccaaggctcttgttcacttcctaaattacccctaatagcactgttcttgctttgtttttgaaattaaaagcagttatttcagagtcttgcttgtgtctctgattatatttatgcactatttaaaatcactgctgaggccaggggtaattcgtactggtcatcttctctgggtgtgagtcaaatataagtttaacaattagctctgaaaacattccattgagctggggaatgcaacagtcttattacctcatcatggaattctctagcttagttaatttaaatattgtttcttagtttctgggtcaattaaatttaaatgatgtattttatgcttcgtgaccaattaaattactaggttattacaaaaaaaattatcatcttttttgattaaagagctgtgggtacagtatattttataagcaattttcattagttcaaaaatgttcctttaggctagattaagcagccattcattgttagagcctggagaccttattcgaaggtgttcatcgtattcacagtgcactattacttagaactaaagccaattgaacctacttagcaatagcgttatgcctttcacccttgatgattatggagcttatagctctcagaaacaatacacctgtcagtttccatcaactatagcaatccatgcagaagacaagaggccccctcaaagcaggaggggtattgttttaggtccaatttttcttattgttctcaaaatcattataaggtggacagtgttttgtgaagattttcttttccccagctctaagaaaccatgtggaaagaattcattgataactgttttgatttttttctttttttaagtacaggttttgctaagtaatcacccttagtgagcctgtgtagttcagctgcctgtgagatgtttggtgaccagctcagtgtattcttgtattcttgatagagaatatttcaggagacaaaagtgcttcttcagaccagacctcaaataacaattttattctttttaataaataagacctcagtaggcggacctgataacagtgacaatgaaaggaaaatagtggcaaaatgtgagtttccagcatgatgtttctcattttattttcttctgtatgaatcaaaagaatgctttacaaaaccatgttcccttaatcacagggttctctggcttttataggattgtcatagccaggaccacactattgctttttcataacattttctttttgtttctttcttttgaatttcttacagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaa

SEQ ID NO: 12389 - DNA, 474 bp, Homo sapiens
  ENST00000490726
tttgcttttgaatttgctttaaacctgtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaagg

SEQ ID NO: 12390 - DNA, 3530 bp, Homo sapiens
  ENST00000398506
gagacatgcccgtttcaccttctaccctcgggagaatgcttctctttctctctttctttcttctttccttcttgccaaaggagcctgaatttctaaactagttgatagggacacaagttagggcaagatcattcatcccagacgagtctcgctgagaattctgtattttttacttaaagctttaattttaaaataagaaaaactcagctttatagatgcaaggccaccgaattccgggtggaaggacccagctgtattgaccttatataagctcggtgccttgccgttctcccatttgcccgcctggcctcctgaaccttctttctctcctgtttgtcatgcagtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcatgctgactccactgcttgaaaaatttgtttactgccccccagatttttaaagattaatacagtaaatataaaaattaattttggctccctaagccatatatgtatttgacaattttaaccgcaaagtaagttgtttaataataaccactgatttctttaagctgacttaatgaactcctaatatcagcaaatttgaggcctaaaggcactaaactaactctagactcagaattacatccaacagaattactcatctaatatcagtgaaattattcttgcacataaaggcaaacctaagtacaaagttaagtcttttactaaaggatgttacctaggatgagcagtatatgtttattaggaaattaactacatgaattgaagagaccagacttcaaaatctaatttttataaatatgctctatgttctcattggataaaactggttattaaccaattttccagaacagctgtacaagatttctgcatggcagccggctaaatggtagaaaataatatgtttaagctggaatagcttataattttatttaaataaaattgctgctataaaaa

SEQ ID NO: 12391 - DNA, 2836 bp, Homo sapiens
  ENST00000495021
gttgacagtcggccccacggccatggacgtcctttccccaagttagctgagcgcctgccaccgagatcccccgagcctgggcttcgcgcggccgcctaggaggaacccgcaggaaccagccctccccaactctccgcccggcgcctttctcctccaccggatcctggatgtgcagtggaggggacgagggcttgtcgggtgggaaacttaattcaaaatggctgctggaaacgcttgggttttattcgtagcaaatgttgccaatttctccggccagatacgctaaaccgatcctcagataccgtccatggctcagggcctccgacttcagggctccaggaggaaggggagacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtca

SEQ ID NO: 12392 - DNA, 551 bp, Homo sapiens
  ENST00000409622
cactttcaaaagtagccagcacgtagtcggccttaagccatgcatgttacctccaacctcagattttctctctgtctgagtgtctgtttgcagataacttaaaatcacccatctgcatccccactcaccctccagaaagcaaacgtggagagctcactctgcagaataaaatcaagaacaccacggttgtagctgctgtggactcggcggtctgagcagcctccccgagagccgtagttgctagtagaagtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtga

SEQ ID NO: 12393 - DNA, 363 bp, Homo sapiens
  ENST00000437869
agctttgctttgagagccctgagatttctagaccggtcttcccgtgcctgcagatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaag

SEQ ID NO: 12394 - DNA, 526 bp, Homo sapiens
  ENST00000466811
agaccggtcttcccgtgcctgcaggttggctgcaaatgtttctgtacacggacaactggtccgggacaagatcccggggaaataaattcatctcgagaggggccgggcgagccagcgcggggaaacgcgagcttttgttttttatgacagccgggctgcgcagctctaatcagcgcggggatttatctcccggcctgtcagcatgtgtgcttaaactttgcggacttcctagccctctaagtcccatcacgagggcagccaccggacaagagcccccaaacaaccagtttgcctgaaaggtatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagaacaaggagcactgatactaagttacg

SEQ ID NO: 12395 - DNA, 532 bp, Homo sapiens
  ENST00000498705
aggacaattgccctgtgtttcccctatttggaagtttggatctcacaaggggggtggattgcacttgtcaatgtcatttatgcactcctgattatattcccatttttttatttctgtcataatgtaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaaca

SEQ ID NO: 12396 - DNA, 564 bp, Homo sapiens
  ENST00000606455
atcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattgtattacagagagccatacaagggaggaaaagggcaaaggtttattaatgcccggagaagaatagtgcagcccatgatagaccagtccaaccgagcagtaagtcaaggaacaccttataatcctgatggacagcccatgggaggtt

SEQ ID NO: 12397 - DNA, 573 bp, Homo sapiens
  ENST00000475239
tttggctgagctcgtggcgctgttggcctatgcgcctgggctcgcttgtgtgaccccctggggctcacccaagtttcagctggtcggaggacagcaaacccaagaacaaggagcactgatactaagttacggatgtaaaataaaacactgggaagcaaacagtcttataaagaggattttataacatcagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtc

SEQ ID NO: 12398 - DNA, 1733 bp, Homo sapiens
  ENST00000409517
acagatcatagcggaatcagaatttccagcaaggaaaatcttttcatggtgaattaagtggtggatgaagaaaaatggtgatgaaaaaagccctcttggaacagagatcatgatgacacggcatctactcgttcaggaggaaccccaggcccttccagcggtggccacacgtcacacagtggggacaacagcagtgagcaagcacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaa

SEQ ID NO: 12399 - DNA, 553 bp, Homo sapiens
  ENST00000542964
acaggagagcagtattcagttctggggaaagaaagggctgggccaggggaggggaagagagattcccagccagctgatgttggagagaagactagatccagaagaggaccaagagcagagaaggaagtaattccttggtttctgtgacttctttctcacccaagatagatttcaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccagggctgc

SEQ ID NO: 12400 - DNA, 558 bp, Homo sapiens
  ENST00000450027
ggagaagtcagctccaggaatgaagtcactgctgacattttacaaatgtggttcagagctgctgcctgctgccgtgtggtcggccggcggttctccaagtttgtttagtgatctcaaaagtaaaaaaggaaagaaattctcgagagaccacattgaggtgactatatcaaattgcggagtgaatggaaatgctaaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaat

SEQ ID NO: 12401 - DNA, 4822 bp, Homo sapiens
  ENST00000561208
cgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgttaggcttttgcgtttttaatggttttaggacaagactgcacaatgccaactctatacagtgttaaaagtaggtttttccccccagcagttgagtatattttaaactcatcaataatttttaaggtaatcatctatagcctttcaatgtctatttgacctataagttccaccagcagaaaacttctaaaggtacgaaactatgtgtacatgatgagccaggttgaaagatccccttgaacatgctcaacctcctttttagatgcatgacgttaaaaaatatatactttcagataaagcttttcatgggcatcctctgccagaataaaggacttttcagggttaattttacaacataagaaataatgtctgtgctcaaaggtaatttatctgcctgtgtttttcctctgcctgtcttactacaatattgttggatatgtaaatgaaaatttacatatgggtgttcatagataagtaaacaacttctatggagtttgaaattctgactttaaaagattacttaatcattaatattttataaattatattgtggtatatttttatttcagacacatccatgtgcagggatgctagtgtgatgatttgataactaaacttaaacttttttctgaaaacaaaacaaaacaaaatggacggtataatgccattttcaaaattttatgcaacattcctggaaatctataccattagcttattgatactgcacaaacaatgtctgctaaagtgtgcaaaaagggtgaggcatgtcccctcaattttcaaataaatatactatcctggaattttttaactcttaaattttgaatctttgtttagaaagaataatgtcatatactttggctagatatgtgatgtcaaccggctaaggaaattattcatcatctctgcaaacttaaacttggaagaaatccatagttattatttggggctcttccatctttccatttcagacagcatttatggaggttctatataaatgaacgaggaaatacacttctattgttttgtgttatatttagtcaggtagaatttttacaaatacatttcagtttaagtgttgtgttgctgtttaaacatagaaataatgcttctgacacaaactaacttaatagagaaattcagtgccacttgggaaagagagatagcttccctctcatttttgctattctattttacatgaagtctttttgtaaattttaaatatttgcctatttttactttaaatacttttatgtaaactatgaaaattccccattataaatcaactctcacatcaggtgggaaaaagaacctttttttctttccactcagtaaattctgaagggtttccttggcaattggctcgtgtttaggatgtgttttatgcaattatcaagttatctcattgaagtttagagaccagagctctcaactcttggttttaatgaataaagtcatctcatgcttagtttattcgtcaaacccacgtcctatcatgttaactttaaccttcttaaatatttggagatgaatgataattgtaatatttgtttgcattaccttgctctcccccacccccaaccccatgataacacagagaagtgatagatttgtccaatttttataatgctttttttacaccaccccggaaggcacttgctcctatctcgggtttactatttagtgtaaagagttccgatttgggtatatttaagaaagactcagctgtcaaaagcaaagaaactgggaatggtgttttgacaaccatatagtgttaaaggaaatactgtagtctgaataaaattgcttatgttctccaaaa

SEQ ID NO: 12402 - DNA, 4829 bp, Homo sapiens
  ENST00000338564
accgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaacatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgttaggcttttgcgtttttaatggttttaggacaagactgcacaatgccaactctatacagtgttaaaagtaggtttttccccccagcagttgagtatattttaaactcatcaataatttttaaggtaatcatctatagcctttcaatgtctatttgacctataagttccaccagcagaaaacttctaaaggtacgaaactatgtgtacatgatgagccaggttgaaagatccccttgaacatgctcaacctcctttttagatgcatgacgttaaaaaatatatactttcagataaagcttttcatgggcatcctctgccagaataaaggacttttcagggttaattttacaacataagaaataatgtctgtgctcaaaggtaatttatctgcctgtgtttttcctctgcctgtcttactacaatattgttggatatgtaaatgaaaatttacatatgggtgttcatagataagtaaacaacttctatggagtttgaaattctgactttaaaagattacttaatcattaatattttataaattatattgtggtatatttttatttcagacacatccatgtgcagggatgctagtgtgatgatttgataactaaacttaaacttttttctgaaaacaaaacaaaacaaaatggacggtataatgccattttcaaaattttatgcaacattcctggaaatctataccattagcttattgatactgcacaaacaatgtctgctaaagtgtgcaaaaagggtgaggcatgtcccctcaattttcaaataaatatactatcctggaattttttaactcttaaattttgaatctttgtttagaaagaataatgtcatatactttggctagatatgtgatgtcaaccggctaaggaaattattcatcatctctgcaaacttaaacttggaagaaatccatagttattatttggggctcttccatctttccatttcagacagcatttatggaggttctatataaatgaacgaggaaatacacttctattgttttgtgttatatttagtcaggtagaatttttacaaatacatttcagtttaagtgttgtgttgctgtttaaacatagaaataatgcttctgacacaaactaacttaatagagaaattcagtgccacttgggaaagagagatagcttccctctcatttttgctattctattttacatgaagtctttttgtaaattttaaatatttgcctatttttactttaaatacttttatgtaaactatgaaaattccccattataaatcaactctcacatcaggtgggaaaaagaacctttttttctttccactcagtaaattctgaagggtttccttggcaattggctcgtgtttaggatgtgttttatgcaattatcaagttatctcattgaagtttagagaccagagctctcaactcttggttttaatgaataaagtcatctcatgcttagtttattcgtcaaacccacgtcctatcatgttaactttaaccttcttaaatatttggagatgaatgataattgtaatatttgtttgcattaccttgctctcccccacccccaaccccatgataacacagagaagtgatagatttgtccaatttttataatgctttttttacaccaccccggaaggcacttgctcctatctcgggtttactatttagtgtaaagagttccgatttgggtatatttaagaaagactcagctgtcaaaagcaaagaaactgggaatggtgttttgacaaccatatagtgttaaaggaaatactgtagtctgaataaaattgcttatgttctccaaaa

SEQ ID NO: 12403 - DNA, 2748 bp, Homo sapiens
  ENST00000397624
catctttatcccttcctctcttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgtta

SEQ ID NO: 12404 - DNA, 3230 bp, Homo sapiens
  ENST00000560702
gggtggaaatatcaggtcagtcctccttggttgctgtaaaagtggtggggaaagagtagataattaagttctttttctgattggaggagggatgcttctggaagtctttgtgatctagtcagatattcattcctcagcaacatttcaggtgacaggtgggaagaaagatgcagtttcaactctccttttgttttcacctctacatagctgatcactttcttttttgacaactgagctacactttcttaagtaataaagaagtccattgttttgcaaacaaacaccatatgcaaaagactcctttggttttctcccagctattattcctcagcttaattgtattcccaccagagtgctcacaggaggcccgaccgagtggggcctgactgtcctcctccaaagggacttcagcttcctcggaacacagagctgccagcacacactgaatttttctggctaatttcaaagagtgagttttcagttcctgcctgtggccccaggtggactcattaatcatgaagtccccctgtgcttaagatctgaaactggaaatattgacagatgttatcaatgggtatatttttagggagaagctagctggatgctccctgctcctccgaaatgcgtggtcagtgaatcgtgtgcatgagctcaaatgtgtggggaatacacgtcgttaagtgcacagggacaagggtaactcacaaatggtagaaaattgttttgtttttattaaatttggagaaataaaggagatttcttatcatcttactctgtttgtacatgaatatttgatgggcattattaaacattaaagtaacatgaagtaggcacttatttttggatttccaacaaaattagatccaggcttcttagatgaaataactgcttctcctttgcattcctgcgattcagccaccacctgatttgcaaacgtttcttgagctctaatatcaaacatgtgtacctgaggctctgtctttctagtgggttgaaaggtggctgggtttatggttggcagttaccttatcctctgccctgggtgtcccagcttaggctggaaaggctgcccccagctggcactgacctctgaatgacccctaactttacaggcttaaactgcaggagttgccgaagagcagaagtctttctggccagcacttattactgctgtgttggtgataaaacttcagacagcctaattgatggctttgctgacctaacaataccttgtgaaagccgagtgctagagcctggtctccatttatgaccagctgcaaggggaagctgggtctccctatcacggggagtctagggaaagggggaaagtcttccagcctgtgaactttaaccagattcctacttgtgcaagaagcagaagcacaatttgaagttaatagaagctttctcatggagaactttattccgtccctgagctcttctagcaagttgttttggagttgactacgcagtgacgacggagattacccagtcaactatttttgaacgctgaaagggaaaatcacctttaaattgaaaagataattttcagaagagatttgactgtattttgtgctcctcagcattcatgcaaaggtgttcgcagagtacagaaacggagtatgatgactggacttctctgttctctttcaggtttattaatgccagaagaagaatagtacagcccatgattgaccagtcaaatcgagcaggcaaccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttg

SEQ ID NO: 12405 - DNA, 2775 bp, Homo sapiens
  ENST00000314177
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacagtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgtt

SEQ ID NO: 12406 - DNA, 2538 bp, Homo sapiens
  ENST00000559085
cttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattg

SEQ ID NO: 12407 - DNA, 2321 bp, Homo sapiens
  ENST00000560570
attggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattg

SEQ ID NO: 12408 - DNA, 2666 bp, Homo sapiens
  ENST00000557796
cggcttctttccctcccgtgcctctgcgtgtgtgcgagtgtgtgtgcgtgcgtgtgtgcgtgtctgggcgcgcgtgttccagcgctgtgcgagcgggcgggcggcgagtgcgtgtgagtggtgtgtgtgtgtgcgtgtgcaatcgttacacgctttcgcctcgctccagcttttaccccagcagcgcgattcccccggttctcctgctgccgctgctgcgccgctgccgccgtggctcgcgcggctcggggcgggcacgggctgcgtaggagccgccgccggggccgccgctggggccgcgctgccgcagccgctgcgccgccgcctagactactagcctgggctgcttgttttgtctctgaaattgacaaggacgcagggaatccgctgctaaataatgtttctgtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaa

SEQ ID NO: 12409 - DNA, 2295 bp, Homo sapiens
  ENST00000397620
cccgatgcctcctctcccttcaacgcttctgctgctgctcgctgcttgatgatggcggccagtattttaaaaaatagcaaaattattcatcggcttctttccctcccgtgcctctgcgtgtgtgcgagtgtgtgtgcgtgcgtgtgtgcgtgtctgggcgcgcgtgttccagcgctgtgcgagcgggcgggcggcgagtgcgtgtgagtggtgtgtgtgtgtgcgtgtgcaatcgttacacgctttcgcctcgctccagcttttaccccagcagcgcgattcccccggttctcctgctgccgctgctgcgccgctgccgccgtggctcgcgcggctcggggcgggcacgggctgcgtaggagccgccgccggggccgccgctggggccgcgctgccgcagccgctgcgccgccgcctagactactagcctgggctgcttgttttgtctctgaaattgacaaggacgcagggaatccgctgctaaataatgtttctgtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttag

SEQ ID NO: 12410 - DNA, 2917 bp, Homo sapiens
  ENST00000424352
ggctcggcgcggcgcgctcctcctcgctcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaattcaagaagcagaaacccctcgcggagttttactggaagaaaaaaacgggtctgaaagattcctcctcttcatcatcatcaaccatcattcattcactaccttgacattccgggctttgattgacagctggagtggcaaaaagccatgaaacacgacagttcggttacatgtgggctgctgacgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagtttt

SEQ ID NO: 12411 - DNA, 541 bp, Homo sapiens
  ENST00000559972
ctgtgtcctcgaatgaccacaatcaggttttcttcttgatccttcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttac

SEQ ID NO: 12412 - DNA, 554 bp, Homo sapiens
  ENST00000561264
cgaatgaccacaatcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactat

SEQ ID NO: 12413 - DNA, 558 bp, Homo sapiens
  ENST00000561284
gttgtcctctattagaaacttcaaggagaagagccttctctgaccctcctgagcatctctgctggtttcaaggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgt

SEQ ID NO: 12414 - DNA, 567 bp, Homo sapiens
  ENST00000559371
tttatgaccagctgcaaggggaagctgggtctccctatcacggggagtctagggaaagggggaaagtcttccagcctgtgaactttaaccagattcctacttgtgcaagaagcagaagcacaatttgaagttaatagaagctttctcatggagaactttattccgtccctgagctcttctagcaagttgttttggagttgactacgcagtgacgacggagattacccagtcaactatttttgaacgctgaaagggaaaatcacctttaaattgaaaagataattttcagaagagatttgactgtattttgtgctcctcagcattcatgcaaaggtgttcgcagagtacagaaacggatgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggact

SEQ ID NO: 12415 - DNA, 547 bp, Homo sapiens
  ENST00000557992
tttcttctttctcctctgtgtcctcgaatgaccacaatcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtaagtacagtcgggtgcgatctgtcttcactatcacttcagagactttattttattttttataatttgcccccattttatttttccttgcccataactgcatgcctttccaaactaaggacctgtttttaaatatatatcacccatctctgaagtcacagatgacactgatgtgcacttttgaaaaggccaactgacaagcctgcgtgtgttttaagcaggtgggactgccttttagcctatttactgtggccccaatgtgcacaaacacagacatcaggcagatattggacatttaa

SEQ ID NO: 12416 - DNA, 740 bp, Homo sapiens
  ENST00000558643
tcagacagcctaattgatggctttgctgacctaacaataccttgtgaaagccgagtgctagagcctggtctccatttatgaccagctgcaaggggaagctgggtctccctatcacggggagtctagggaaagggggaaagtcttccagcctgtgaactttaaccagattcctacttgtgcaagaagcagaagcacaatttgaagttaatagaagctttctcatggagaactttattccgtccctgagctcttctagcaagttgttttggagttgactacgcagtgacgacggagattacccagtcaactatttttgaacgctgaaagggaaaatcacctttaaattgaaaagataattttcagaagagatttgactgtattttgtgctcctcagcattcatgcaaaggtgttcgcagagtacagaaacggagtatgatgactggacttctctgttctctttcaggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtaagtacag

SEQ ID NO: 12417 - DNA, 1442 bp, Homo sapiens
  ENST00000559561
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaacc

SEQ ID NO: 12418 - DNA, 561 bp, Homo sapiens
  ENST00000559408
acttgtccacttgagggcttgacaggcagctaacagctggcctgctagactgtatgggagaatcagcctacatcttcttctgagcagatgacaagctaatcagagacatatccatagcacagggcatgtccccggtcactgagctacctacgcctttccccagttgatctgatctctcttcaacggttcagtccccttccctgcgcaaagcaatccatgcagaatcttcaattccagctattcttgattcctcctcagagtgttcagggatggcagctttccagtatccaaagaaatgacctttgagtgaacctctaaccttccccaaacttcaaggagaagagccttctctgaccctcctgagcatctctgctggtttcaaggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatg

SEQ ID NO: 12419 - DNA, 705 bp, Homo sapiens
  ENST00000607277
gaaggatttcgctggatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggt

SEQ ID NO: 12420 - DNA, 1643 bp, Homo sapiens
  ENST00000561163
ttttcctcacaacttttaactccgttgttttggctggtttggtttctgtgtgctcaacttgtgctcggtacttttctcctttctgactttgtttttatttttattttctctctctctctctctctctctctctctctctctctctctctctccccctctcctccttttcctcctcctcctctcttctctcttacctccctccctctctctcatctttatcccttcctctcttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacagtaagtcaagatgaaagagaaaaaaaaaatagtttttgttgttttgctagcaagttatacggtctcatactgatttttttttaaactaaggtgcctattttcttattcttgaaatctgatgactaacagactagttaaagttttttttttcatcaactattaccatccaaagagcaccctctagaaagtagcaggtttttgttttaagaagctgggaatggactttatttaaaatgatctaagaccctaaacagcatatataagtaaatttgttatttatgctaaaagtatgagagcaacttcggatactgcaacagcaaccaagggaaatggctgtaaggagctcacaaatccataaacgttgctgattacactgttaacgaaagctgtctcctctaggaggccaaaaaaaaaaaaaaaaaa

SEQ ID NO: 12421 - DNA, 545 bp, Homo sapiens
  ENST00000606653
atacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaagaatttttcagatttatccccattttccagatgaagtggcttggccttggagagggtcagttacttgactgtcacgatagaaagaggaagcagaagaatgaagacaaagccatttaaaattttcttgttctttaccttttgcataaaaggtattcagttcacaaatgatgtaaaatttaattaaggcaagtgactgtcctgagaaagtcattaaaaccctcatgtcatttctctaatcaaaa

SEQ ID NO: 12422 - DNA, 565 bp, Homo sapiens
  ENST00000561422
atttaattccctggactcccactctgaacccagttatttccagtcctgtttctttctctctctattgtaacttgttgctcagagaagtctctggagaataatatctgctgcaacaattactctattgtttccttgccttcaactattacaccctttaattagagttagtttggaagacatcacactgttgctctttgcaaatgtaaccttgcaacctggtatttttcctttctaaaaatgaaacaaaacaacaacaacaacaacatgagctaaaccctccaccatgaccttcgttctaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaagg

SEQ ID NO: 12423 - DNA, 605 bp, Homo sapiens
  ENST00000560617
ggaagatggctggaaattattttatattctgagagcacttggcgaggggtgagatgcacgatcctaacgtgtaccacacgagctcttccggctgagggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaa

SEQ ID NO: 12424 - DNA, 1088 bp, Homo sapiens
  ENST00000558313
tgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcgga

SEQ ID NO: 12425 - DNA, 552 bp, Homo sapiens
  ENST00000560697
gttgattacagttcttgctccttcccctctgcaccccgtctctgtgtgtgtgtctctgcgtggcgctgcccgttaggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatg

SEQ ID NO: 12426 - DNA, 552 bp, Homo sapiens
  ENST00000559129
ctatctgttcctctggcccagtccgctctctacgcctcctccccatccctgagcctgggggcgaattggaagtggagataaatatgggtgtttgttttcccccccagcaggaatacaggggtcgaccctcgaattaaagttgacctgctcctaatctggggcttggcctttttcccccgcctccagctacttgaacaagaattggggagaggggctgtgagggacccgggagtgcccgggaggcaaggaagctgggcgcctctccgagcggtcccaggcagcagtggagagccacagcctcttggactgctggatatggaactcgaggccctgagaacgaccctgagttcctggctacagcttagtcgtaccaggtcccccttaatggggccaggaccagaatgccctgattcttcttcagggactccactaatttaaggttcgcgccgaaaagccacttttttcctcaaatccagagctggacaatttgatgatacaagcaatacaagtactaaggtttcatcttttggagttagaaaaggtaagcaggaa

SEQ ID NO: 12427 - DNA, 3056 bp, Homo sapiens
  ENST00000340545
ttggctacatcggacccagatgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgtt

SEQ ID NO: 12428 - DNA, 2195 bp, Homo sapiens
  ENST00000561204
actctcctcctcctttctgcctctctgtccccctctctctgtccctggtctcccccctctttctgcctctctatccccctctctctgccctcccccacccgcagtctctctcctctgttcctgggcttcctcctccatctcagccgcccgcacctcaccgtccccccttttttctgctctcctccgtccttcccttcgctctacttttgttccaagccgcccctgcctctccagggctaggagtgggacaggggtgggagaggtggtctcaccaggctgctggccccacggagcctgtctccctggggatgggaacggggatagaagacaggggaggaggcgcgcgcccgttttgggggttccgggtaggctgtgaggaccgcttttggtgagagtgccttgagcagcggggagcagttggattcaacttcagggcacaggagaagttaggagaagagggagagggaaagagtgggacacacagaaccagggtgcccagccaggcgagggtccgaggcaggaacgttctagcctcttcccgtgcgagtcctgctgcctctttgagcctccgtgtcttcatcactgaggaagggatttgacctgatgagaggaaggtgcccctggcttcccagtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 12429 - DNA, 1758 bp, Homo sapiens
  ENST00000441740
atgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 12430 - DNA, 2104 bp, Homo sapiens
  ENST00000331559
gaccgggaacggggagcgcggctgccagcacccctgagccgccgccggaccctccgtcgccccgggccgccccccgccccctgcggtccccggtgtgtccgtctcgggacggttcgattccctccagagccggggaagggacggggggggcccagaggagggggcctcgggcgccccgcctgcgcctgctgcccccgccccggcggcgatgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 12431 - DNA, 1199 bp, Homo sapiens
  ENST00000560245
ccgcccccgtccctgagcacccccgccctgcccccgtgggtggccccccccagtaccccggtgcccccccaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgg

SEQ ID NO: 12432 - DNA, 1883 bp, Homo sapiens
  ENST00000561096
ttatctgccaactgtgaaatgaaatagaagacagggaggcttcgtatgtgtactttgtgtacaacaatgcgcggttcctacaggaggtgtccatggatctccctctctgtctgtctctctctctgtctctgtcactgtcttctcacgccactttctccatctcttttccctcccagccagaccctgccgtctctccctctgggtcctcctgcccacatgtcaggaatctctgcctggacggggtcctcactccccaccgaggcagctccaggggacctggagggcttcaagcttgggggctcagacacctggggaccacagtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgg

SEQ ID NO: 12433 - DNA, 1918 bp, Homo sapiens
  ENST00000561293
ggggcgggggccggggtccatgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacg

SEQ ID NO: 12434 - DNA, 1060 bp, Homo sapiens
  ENST00000560253
aggaggcgtggtcaccagaactggagagaggagcagattgcttgacagcggctaagatttttggtagaagaatacagttaatctaaaaccacttggcagatttaacccaacgttaaactgaaaaacaaagaactgttactgcagtccatatggaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccggacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaaca

SEQ ID NO: 12435 - DNA, 1715 bp, Homo sapiens
  ENST00000558555
atgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctccc

SEQ ID NO: 12436 - DNA, 1828 bp, Homo sapiens
  ENST00000559524
aggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagaggtgtgagggtctaagggctggggattgtgcaattctcaaacctccattagacctcaggactccaagagtgggcacttccagagtagtgggtcagcctgggtccctgtactgtgggttctctgaggcttgatgggaagatattcatccatctgtccgtccgtccatccatccatccatccatccatcctcctcctccatgtatccatccatctacccactcactcacccatccatatctttatccatccgttactcaattactcattcacccgcaatccatccatccaaacctagtccacccacctacccactcattacccatctgaccacacattcacccactcactccattcatctctccactcgccaacccactcatccatctacctccacactgaccaaccacccacacatctacccatttatctgtgcattcacccacctccctacccaggcttccacccacctacccatcaactcacccatccatccacccacacatcc

SEQ ID NO: 12437 - DNA, 378 bp, Homo sapiens
  ENST00000607695
ttccccaaggtggccaccaacatcatgcgagcctggttgttccagcacctctcggcgggggctggcaggcatgtaattgccccaagcctgaggctcccttggtctccatcctggggagcgcagagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatc

SEQ ID NO: 12438 - DNA, 532 bp, Homo sapiens
  ENST00000559338
ccggcctctctcttccctcccaggttcgctctgagaggcccctcttctcctccaacccagaactggacaatctgggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgagacgctcagaagcgccggttctcccagacgtctgcctgggcctgggctccccatcccccggaccccggtgggccagaccttggggttcagactgcgg

SEQ ID NO: 12439 - DNA, 733 bp, Homo sapiens
  ENST00000557833
cggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtgagcgcgtctcacctccccacaccctcacttgcccctgtcatcccaccccctctcgtcgcctctgccccccaccttccagctctctccccaccggagttgaagcagaatgccgcccccgtccctgagcacccccgccctgcccccgtgggtggccccccccagtaccccggtgcccccccaggtccacgacctgtgcgacaacttctgtcacc

SEQ ID NO: 12440 - DNA, 515 bp, Homo sapiens
  ENST00000607330
gaccgggaacggggagcgcggctgccagcacccctgagccgccgccggaccctccgtcgccccgggccgccccccgccccctgcggtccccgtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctg

SEQ ID NO: 12441 - DNA, 1809 bp, Homo sapiens
  ENST00000561040
cacatgagtgtgcacgtgggttggtgtgtatggctgtgtctacatgtgtggtagattcacgtggcgagtggagtgtgacatgttgttgagacttactctgatgcgcttatctgccaactgtgaaatgaaatagaagacagggaggcttcgtatgtgtactttgtgtacaacaatgcgcggttcctacaggaggtgtccatggatctccctctctgtctgtctctctctctgtctctgtcactgtcttctcacgccactttctccatctcttttccctcccagccagaccctgccgtctctccctctgggtcctcctgcccacatgtcaggaatctctgcctggacggggtcctcactccccaccgaggcagctccaggggacctggagggcttcaagcttgggggctcagacacctggggaccacaggcaggtttctgggacacagaagggcatctcctgggttccaggatagagaagctcctcagccgagtctcggggtgctgacccctccctggggctccgcccttctcttctcaccttcccccagtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggtgggcacctcccacccaccacacaccgagtcagagagccagcgaggaggggtgggtggaaggcgggacatccccctgccggcctctctcttccctcccaggttcgctctgagaggcccctcttctcctccaacccagaactggacaatctggtgagacccgagccctcccccacaccccctcctccaatgggtctccttccctgacgccccatccctggggttggtggggggggtgcagagagaaggccacctggtccatgtccccaaaccgtcatgattgttgcccacgtgccgtgtggtacagcctagagtctgagaacgggacccatggcccgagttcaaatcccagctctgccactcaccagctctgtgacccagggcaagtcactctgcatctccgtgccttggtgtcccgtctgtgaagtgtggctggtagtaatgtctgtcttggagggctgctgtgggggtttaatgagtgaatgcgattcaagtgcgtggaacagcacctggcacagaatagggctcaaaaagtgtctgatgttccatccgtcagaagatcagcacctatgccaaagtgagcgcagggactgctgcccaaggagaggaggctgggtgcggcagctcacgcctgtaatgccagcactttgggaggccaaggccaggagatagcttgaggccagggatcgagaccagcctgggcaacgtagcgagaccccacctctacaaaaacatttaattagcggggtgtggtggcatgcacctgtggtctcagctactttggaggctgaggcgggaggatcgcttgagccccaagaggtcgaggctgtagtgacccttgatcagctccactgcataccagcccaggcaacagggcaagaccctgtctctcatagagagctagagaaagagaaagaaagaaagaaaaa

SEQ ID NO: 12442 - DNA, 3954 bp, Homo sapiens
  ENST00000295408
aacctgctgggcccgccgggactcgcccccctgcccgctcctctcctccagccccggccggcctcggctcggcccccggcccgccccttccagccctcggcacctcccgccggccgcttggctccgccactcggcactcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataaggaaggatatgttgaacttacttgagacttgaaagacagtggtcggcagcggccttgtggcctttgcaaaggaattcccttaatgcctggtccttggggcaattgctctgaccattcttggcattgctttatagagatatggaaaaaccacaccagggtctgtagataaggaataaagaatattgaaggattgaaaaa

SEQ ID NO: 12443 - DNA, 3189 bp, Homo sapiens
  ENST00000409780
cgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataaggaa

SEQ ID NO: 12444 - DNA, 2972 bp, Homo sapiens
  ENST00000439966
ggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttg

SEQ ID NO: 12445 - DNA, 545 bp, Homo sapiens
  ENST00000473065
gatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggtaagcaatttaaagtaattcttttaaaatgtgggataagaaggtagcagtttagaataattctttaacatatatttattaaataaaatagcatctcaggactctgagttatactatggatagttatattttattatttaaaatgatagactattgatttttgaaactcagatctggcacatgaaaagattctcttcaatgcctagcacatacaggtccttgaaaaatattaattttctttcttcattgaaaagca

SEQ ID NO: 12446 - DNA, 771 bp, Homo sapiens
  ENST00000449344
catattcctctgcagacactattgaagttcatggtggatattgccctgggaatggagtatctgagcaacaggaattttcttcatcgagatttagctgctcgaaactgcatcacccacctggccatcttagcaagaagcccagcatcttgctcttactgcaggttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatggg

SEQ ID NO: 12447 - DNA, 3600 bp, Homo sapiens
  ENST00000421804
ctcggcactcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattaattttctgatatggcttcctaataaaatatgaataagga

SEQ ID NO: 12448 - DNA, 3104 bp, Homo sapiens
  ENST00000616902
actcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggaggcagagattgcatactgctttgccatgtttttacccattcaagccttggcagacagaacttgcagtccttaccttgcagggctccaggacaaacccacatgacattttacaaaataaagaaatgcaaagtttctaacattttaaactacagtagaagtaaatttgttcttccctgttacaagttgggtagattatgccccctcttcaactccggcgcctggcaacgcagatcctgtgctcatcatctttggctgcttttgtggattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctagggttatgcatgattgatgctgtgtttgtaatttcaggtattattatcctgctttatgaaaatcaccgagactcttccaaagagcataggccagcctgtatttttttacatcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagccaggtgggcatgtgcagaggggaggtcgaggttgcagatgaaattgcccatttgtgggagtagggccaccaaaaaagtctcaataatttttataaaaagtagaatgaatgctgataaaaacaaaggcatggattgcacaaagagatgtactcttgctggagaaccgatccctgaccgccccaccttttcagtattgaggctgcagctagaaaaactcttagaaagtttgcctgacgttcggaaccaagcagacgttatttacgtcaatacacagttgctggagagctctgagggcctggccctccacccttgctccactggacttgaacatcgaccctga

SEQ ID NO: 12449 - DNA, 3325 bp, Homo sapiens
  ENST00000568223
tccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaagctgctgtggacctggtctcctgtgtccagcccagccttgggcctgcctcgcagctgtgaggatggctccaattcctgcctcctggcgggagactgaggctcaggggaatggtatcttgttcaagaccatttggcaactgagagggagagcagatgtcaggaggagctacacccacattccggggaggggccgctgctgggtggggggcacgtggggacctgcactcatgcaagcttctgctctgctgcacccaccagccccgtccttgcccgcacccttgcctgcttccctggctggctcccacttgcctcccgtgccaggtgcttctggggctcagcaggagaggaaaggggcagaggggcatagggtccctcgggtacggtgggggcaggcgggcgcacagcgctccggctctgagccaggcctgtgagggaaggggctgcaggctggcagggtgccgacttcccccatggctgctgtgagcccgcagagtcatccttggccccgtcccgcccttggggaagaatgggcccctctgtcctcaggccccttcgacgtgctgagcatccagacgtggcgaggagcccgaagggtgtggggtcccctctgcagggtcctgcttgttgcctgtttccggcgggcggggtgcacaatggggtctctaaggaccgtttcccgccactggccccattgtcactgtctccgccttcctcctcggcctttcagccgcataaagggccagtgaggtttgggacagccacagcccaaggctccgaggctaaaagcccctgggtgggggtgttccaggacacctggccctgtgtgagctgcctcctctcaccccaacccctcggatcctgggaaagagacagccatggctcaagggccagggacccctgggctgagccccagaaatggctttccattctcgcctgggccggggtgggggtggaggccagaggccctgcccaggcagatgaagcccccagctttcaagggggaaactgaggctgtgtgagggacacagctgtgcagggcccacaaacacggtcctttctctaggttagcggatgcagatgcctgatgagtgccatgccctctgtggacacctggggaggggggtcacctccagcgccgccctgggacttccactgcacgtgcaagagacttaccctttcacacagatcacctgcctgccgcagggctgatgaggatgggtgaggagcgcagccactgggtgtcatgcactgtgggggttctcccaccttctgcccctcctcaggttccttgctgcttctctcctctcccaactgtggcacgctgagggctcaggcacaggaccgctcctctggggcagcctccaataacccttggacaacctccactttttcatcttcagccctgaccactccctggggcccatagccttacatccatctgcccccagcccaaacacttctgcaaacactagaaaaggaggtagcccgtgtgccctcctgcaccgcctcctccactcctgtcttggagaggctttcccgtgggccgagcaacccccttacctttggcacttgccctgattctctggccagcttcctacaacctctccttttcagccacacccaagtccacctgttcacaaacaccctgggctgggccctggccgaaccctggcttctacctacctgtctcaggaagtgcctgagccttgcacctacagaccctcccagagaaagccctggctttgcaaccagctgtcttctcatgagacacagggccacaggagcaccacggtgcccaaatgggtcttggagcattagaccaggggcttcatgcctgccctggggacaggtggccaaagtggcatgggagatagggagacagtgtgggtgagcaggtgggcaggagctacaggagcctggggcctgtggatcacagacaccgccaggcaagtgccagttcacacaggtacaggtggctgcagagtgcccaaaggccaagcagcagagtgcctggtgtggacgggagaggagtggggaggttgggcgcagtggctcacgcctgtaatcccaacactttgggaggcccaggcaagcagatcatgaggtcaggagatggagaccatcctggccaacatggtgaaaccgtctctaataaaacacaaaaaattagccaga

SEQ ID NO: 12450 - DNA, 503 bp, Homo sapiens
  ENST00000570132
gccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcc

SEQ ID NO: 12451 - DNA, 915 bp, Homo sapiens
  ENST00000219542
ctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcggtgagtgtccccgccatggggggagcctggagcctgccttcccctgaatgcctaccgcagccacatgcctccccacagtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggg

SEQ ID NO: 12452 - DNA, 523 bp, Homo sapiens
  ENST00000567076
cgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtgggtgggcccactgctttggaggtgatgggactatcaataagaactctgttcacg

SEQ ID NO: 12453 - DNA, 1174 bp, Homo sapiens
  ENST00000564661
cagctcttgcttggctctcctggagcttggcgcctgaccctgaaagggatgggctctcgctattctgccccctggccctgggccagggaccccagaccacccttcctctgcccccacttcctatcaccctagctgggctgctgctcttcagacctcagatccgggaaactagaggggtcccagatgctggggtgcatatgtcagatgggagtgcaggagggcggcccaggacagctgatcgctaggcatggcccccaggcccacgtctgtgtgcattcctgccttggaggtgcctgcaggccctgcagcgacgctgagctgctcctggccgcatgcaccagcgacttcggtgagtgtccccgccatggggggagcctggagcctgccttcccctgaatgcctaccgcagccacatgcctccccacagtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaagctgctgtggacctggtctcctgtgtccagcccagccttgggcctgcctcgcagctgtgaggatggctccaattcctgcctcctggcgggagactgaggctcaggggaatggtatcttgttcaagaccatttggcaactgagagggagagcagatgtcaggaggagctacacccacattccggggaggggccgctgctgggtggggggcacgtggggacctgcactcatgcaagcttctgctctgctgcacccaccagccccgtccttgcccgcacccttgcctgcttccctggctggctcccacttgcctcccgtgccaggtgcttctggggctca

SEQ ID NO: 12454 - DNA, 612 bp, Homo sapiens
  ENST00000568415
tcagacctcagatccgggaaactagaggggtcccagatgctggggtgcatatgtcagatgggagtgcaggagggcggcccaggacagctgatcgctaggcatggcccccaggcccacgtctgtgtgcattcctgccttggaggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaa

SEQ ID NO: 12455 - DNA, 4076 bp, Homo sapiens
  ENST00000548553
taaagagatagagtctcactatgttgcccagacaggatttgaattcctgggctcaaggtatgcttctgtcttagctcctcagtagctgagaccatgggcacccaccactgtgcccagattcgggctttcttgtaaaaagcggatggatgcttgaaactattttctgaatccctttggctcccaaatgtgaatattctgggaaatatttttatccaaattagctgagtaatcgagtagttaggcacattttgaagactgaggcttgtcctttaaaagaagggcagcccacaaactgacttccttgagccaaaaattgttttaaaaggggaagtacagcccaaaacagtgattttaaaatatcaacaaaaagagtcaaattctgtaaaatatttaaagagatttattctgagccaaatatgagtgaccatgtcctgtgacacagccctcgggaaatcctgagaacatgtgcccaaggtggtcagggtacagcttggttttctacattttagggagacatgaggcttcaatcaaatacatttaagaaatacattggttcagtccagaaaggcaggacaacccgacgcgaggcagggagcttccaggttatagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgcttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaata

SEQ ID NO: 12456 - DNA, 618 bp, Homo sapiens
  ENST00000550502
acatttaagaaatacattggttcagtccagaaaggcaggacaacccgacgcgaggcagggagcttccaggttatagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgt

SEQ ID NO: 12457 - DNA, 1825 bp, Homo sapiens
  ENST00000547104
tgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaa

SEQ ID NO: 12458 - DNA, 1846 bp, Homo sapiens
  ENST00000550097
ggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgaga

SEQ ID NO: 12459 - DNA, 3390 bp, Homo sapiens
  ENST00000332160
agaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgcttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaatatggttta

SEQ ID NO: 12460 - DNA, 104 bp, Homo sapiens
  ENST00000563026
caggaggctctctgagaagagacagcaaagcttcttagatggatcgaaagaccacgagctgggataccaagttctatgaaaagcctgttacattaggcaacaag

SEQ ID NO: 12461 - DNA, 763 bp, Homo sapiens
  ENST00000567404
aggctctctgagaagagacagcaaagcttcttagatggatcgaaagaccacgagctgggataccaagttctatgaaaagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagct

SEQ ID NO: 12462 - DNA, 3256 bp, Homo sapiens
  ENST00000358154
ggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccatt

SEQ ID NO: 12463 - DNA, 1817 bp, Homo sapiens
  ENST00000396014
ggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaa

SEQ ID NO: 12464 - DNA, 701 bp, Homo sapiens
  ENST00000562379
ctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccaggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaac

SEQ ID NO: 12465 - DNA, 447 bp, Homo sapiens
  ENST00000570074
gcggccgcggcccccgatgagactgctggcgggctggctgtgcctgagcctggcgtccgtgtggctggcgcggaggatgtggacgctgcggagcccgctcacccgctcccttggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcatttt

SEQ ID NO: 12466 - DNA, 785 bp, Homo sapiens
  ENST00000562961
ggaaaggcaacttaatctggtcactggagtgttaaattctgttgcttactttgctatttgggtttgtttggtgattttgagttaaggcattggattatgtgactgttttcttgtctaaaaacaaggatgctgctagctgtttgccttctgatgttgaatctcagtgaaagagaggccagcagagctttctaaatctcggtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacg

SEQ ID NO: 12467 - DNA, 376 bp, Homo sapiens
  ENST00000568826
agagttaccttgatcaaggaacacagatcttcttaaacaacagcattgagaaatcgggctggctatttatccaattatatcattcttttgtgtcatctgtttttagcctgtttatgtctagaacatctatcaatggagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactg

SEQ ID NO: 12468 - DNA, 480 bp, Homo sapiens
  ENST00000569290
accagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacggtaagtgtggtcagtcaggctagctcttactgaggatagctgtttattggtatttgtgattttgtgctgtgtacaattaaatattgtctagtatgtcttataatagcctgcagtttaa

SEQ ID NO: 12469 - DNA, 5603 bp, Homo sapiens
  ENST00000564733
ggttattaaaagtagaagcaaaaagtcacccatagtccttttgcctgaaataactcccattaacattttgatatatttcttcacagatgagaaaaaattaagaactttccccccttccctgccctataatccaaattgtgtgggcaaatctgagattactagatgtattggaaatcctttctctttcatagataaaaaaacagaagtagacagaattttaaaaatagatatactatgggatggctattggagtcatggcagttttttttttcttaaatgaaaagtacttttatagaaattgttctttgaaaatattcagcaaataatcatttattgctttctatgtgcagatcaagtttgtatgataattaaattattgataacttatacctacgattttaagaatattttcaaccctttggtcagattgtctccaattagcataatagcaaagagacttttcaaggttaatatgaaactttttctcagctatttttttattgtctatttctcaggggaaaaaggaaacttatcctcttaggcagttttcataatgttatacatttaaaaattaatctgaaggagcttaaaatataaatgcattaggtgaaaaatagcagttgatttaaataaaatgaaggaggagaagaaaaagaaccttaccgacacaaaatagaatgagattggtttgcagatggcgagcgatgttgcttctgctcgcagtccccatttctgtgtatgccggggcgggttggggtgtgtatttgaaaggaaagttggctttcttttttcagaagggaagaagagctgaagagaggaacctcttatgaaggaaccataatcaggaactttttgaaattgtgcaaggatggcttcaccatttaacattgagattttggcctggagcacatttagaaatgtgcatatcttttttttttccatggattttacagttgtcataggtgttagatgtttctgggtgagattttgatttacacctagcacatatttccaggaaggagtattgtttgacaaataattcgtacttggatttttcagaacagttcagtcactgtctagggtacctgctctgggtgccactctgggccagtaactgctgggaacaaagaacagcagaaggagaagtggctttgtgtagagatgagaaaagttagtaaacaacacattctaatgcagcgaataaataaattgtctgttattaactttttgtactccagttttgaatccaaagacacctgccttccccccttttttgacagggtctctatcacccaggctggaatgcagtggcaagattgcaggtcattgcagcctcagcttcctgagtagctgggactacaggcatgcaccaccacccctggctaatttttttttttttttgtagattctgtgttgtctaggctagtcctgccctcaagcgatccccctgccttggcctcccaaagtgttaggattacaggtgtgagccaccatgcctggcccaaagacccccttttaatgtgttgagaaacaaatatgtgggccctctgtcctctgtgtcctctcccccagcacttagtggtgattcagtaagggtcttctttgtaaagcagcagaaacagactcaggctgacttaaaaggaaatttatgcaaacatttgaaggtagatcctagagtcactgggagggctagtgaatcttgtgtggggtccacagccaggaagaatgcctcaaatcacaccataaacaggtctgaagaggatgctactgccactgccaaacactaggtgccatcagccctgttgtcagcatcgctcaaccactgccccagccccttggtctcactgccattgctccacccccagagaaggagaagctcacatccccactactctgggtcactggctctccattccagggcatgggcaagtgtgcctggcttaggctgcgtgccagtgcctcagctgcacggcaggccaggaaagcggctcccaggccttgtgtctctcccagactctgggcaggcaattccccagacatgggaagagcgtcatctgcaccactgaaaattatgaaaaatctccccaccatgatatgatgtctgtgcccttggcatctgctcatgatatattttctcattaacagaaagttattctcagtctgttttgtttttttttttttttttttttttgagacagagtctcgctctgtcgcccaggctggagtgcagtggcacgatcttggctcgctgcaagctccgcctcccgggttcacaccattctcctgcctcagcctcccaagtagctgggactacaggtgcatgttgccatgcccagctaatttttttgtattttttttagtagagacggggtttcactgtgttagtcaggatggtcttgatctcctgacctcgtgatccgcccacctcggcctcccaaagtgctgggattacaggcatgtgccaccacgcccggcctcaatctggttttaacacttcaacagatgtatgtagtttttgtatcaccatagcacctaaaaagtacccccaaagttaaatatactgtcatctctgtgtgtgtgtctgtagtcagtgccaggtttgtatgtgaatttgaggaccttccctagtccccttgtcccccaggcatctcctgctcataggtttggaaatgactgatagaggcttcatctctagtccaagaaatgctggacggtgtatccatcctactgttccatctctctctggtcctggagcttaatgtttatgaaattgttctgaaaaggcaaagaatgagtcaacttccctagaaaaactccccaatgatctgcttttctaaattaaaatccttcatgagcctgtttttattttcagcctaataaatctctctaggtagtaagttgcataagtttactatgccagtggtattttcttgcatttgtccaaaactgtccttcagatattacatgttgctctctgtttcagtattccagcatttaatgaccagttttccaaacccattaaccattacaccctgcagtcagtctattggcagatactacccaaaactgtcagagaagataacagtgtggggccttggatccagacaaacctgggcttacatttccatactgacactcattaaccttgcaagcgtgggcaagttcttcaccccttctgagtctgttctttatctgcccacctgtctcaaagagtacctgggaagtacaaaagaggtaactcatgaagccctcaggcttggaacgtaccaagtccttggtagatatggctcctccctgcttccctctttaaatcacttgtttgttcaagaatttaactgaatgttcttatttgtattagtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcacca

SEQ ID NO: 12470 - DNA, 2890 bp, Homo sapiens
  ENST00000615720
atgtggacgctgcggagcccgctcacccgctccctgtacgtgaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccatt

SEQ ID NO: 12471 - DNA, 3256 bp, Homo sapiens
  ENST00000640479
ggccgcttgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccatt

SEQ ID NO: 12472 - DNA, 2890 bp, Homo sapiens; identical to SEQ ID NO: 12470
  ENST00000640441

SEQ ID NO: 12473 - DNA, 5603 bp, Homo sapiens
  ENST00000639291
ggttattaaaagtagaagcaaaaagtcacccatagtccttttgcctgaaataactcccattaacattttgatatatttcttcacagatgagaaaaaattaagaactttccccccttccctgccctataatccaaattgtgtgggcaaatctgagattactagatgtattggaaatcctttctctttcatagataaaaaaacagaagtagacagaattttaaaaatagatatactatgggatggctattggagtcatggcagttttttttttcttaaatgaaaagtacttttatagaaattgttctttgaaaatattcagcaaataatcatttattgctttctatgtgcagatcaagtttgtatgataattaaattattgataacttatacctacgattttaagaatattttcaaccctttggtcagattgtctccaattagcataatagcaaagagacttttcaaggttaatatgaaactttttctcagctatttttttattgtctatttctcaggggaaaaaggaaacttatcctcttaggcagttttcataatgttatacatttaaaaattaatctgaaggagcttaaaatataaatgcattaggtgaaaaatagcagttgatttaaataaaatgaaggaggagaagaaaaagaaccttaccgacacaaaatagaatgagattggtttgcagatggcgagcgatgttgcttctgctcgcagtccccatttctgtgtatgccggggcgggttggggtgtgtatttgaaaggaaagttggctttcttttttcagaagggaagaagagctgaagagaggaacctcttatgaaggaaccataatcaggaactttttgaaattgtgcaaggatggcttcaccatttaacattgagattttggcctggagcacatttagaaatgtgcatatcttttttttttccatggattttacagttgtcataggtgttagatgtttctgggtgagattttgatttacacctagcacatatttccaggaaggagtattgtttgacaaataattcgtacttggatttttcagaacagttcagtcactgtctagggtacctgctctgggtgccactctgggccagtaactgctgggaacaaagaacagcagaaggagaagtggctttgtgtagagatgagaaaagttagtaaacaacacattctaatgcagcgaataaataaattgtctgttattaactttttgtactccagttttgaatccaaagacacctgccttccccccttttttgacagggtctctatcacccaggctggaatgcagtggcaagattgcaggtcattgcagcctcagcttcctgagtagctgggactacaggcatgcaccaccacccctggctaatttttttttttttttgtagattctgtgttgtctaggctagtcctgccctcaagcgatccccctgccttggcctcccaaagtgttaggattacaggtgtgagccaccatgcctggcccaaagacccccttttaatgtgttgagaaacaaatatgtgggccctctgtcctctgtgtcctctcccccagcacttagtggtgattcagtaagggtcttctttgtaaagcagcagaaacagactcaggctgacttaaaaggaaatttatgcaaacatttgaaggtagatcctagagtcactgggagggctagtgaatcttgtgtggggtccacagccaggaagaatgcctcaaatcacaccataaacaggtctgaagaggatgctactgccactgccaaacactaggtgccatcagccctgttgtcagcatcgctcaaccactgccccagccccttggtctcactgccattgctccacccccagagaaggagaagctcacatccccactactctgggtcactggctctccattccagggcgtgggcaagtgtgcctggcttaggctgcgtgccagtgcctcagctgcacggcaggccaggaaagcggctcccaggccttgtgtctctcccagactctgggcaggcaattccccagacatgggaagagcgtcatctgcaccactgaaaattatgaaaaatctccccaccatgatatgatgtctgtgcccttggcatctgctcatgatatattttctcattaacagaaagttattctcagtctgttttgtttttttttttttttttttttttgagacagagtctcgctctgtcgcccaggctggagtgcagtggcacgatcttggctcgctgcaagctccgcctcccgggttcacaccattctcctgcctcagcctcccaagtagctgggactacaggtgcatgttgccatgcccagctaatttttttgtattttttttagtagagacggggtttcactgtgttagtcaggatggtcttgatctcctgacctcgtgatccgcccacctcggcctcccaaagtgctgggattacaggcatgtgccaccacgcccggcctcaatctggttttaacacttcaacagatgtatgtagtttttgtatcaccatagcacctaaaaagtacccccaaagttaaatatactgtcatctctgtgtgtgtgtctgtagtcagtgccaggtttgtatgtgaatttgaggaccttccctagtccccttgtcccccaggcatctcctgctcataggtttggaaatgactgatagaggcttcatctctagtccaagaaatgctggacggtgtatccatcctactgttccatctctctctggtcctggagcttaatgtttatgaaattgttctgaaaaggcaaagaatgagtcaacttccctagaaaaactccccaatgatctgcttttctaaattaaaatccttcatgagcctgtttttattttcagcctaataaatctctctaggtagtaagttgcataagtttactatgccagtggtattttcttgcatttgtccaaaactgtccttcagatattacatgttgctctctgtttcagtattccagcatttaatgaccagttttccaaacccattaaccattacaccctgcagtcagtctattggcagatactacccaaaactgtcagagaagataacagtgtggggccttggatccagacaaacctgggcttacatttccatactgacactcattaaccttgcaagcgtgggcaagttcttcaccccttctgagtctgttctttatctgcccacctgtctcaaagagtacctgggaagtacaaaagaggtaactcatgaagccctcaggcttggaacgtaccaagtccttggtagatatggctcctccctgcttccctctttaaatcacttgtttgttcaagaatttaactgaatgttcttatttgtattagtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcacca

SEQ ID NO: 12474 - DNA, 1817 bp, Homo sapiens; identical to SEQ ID NO: 12463
  ENST00000638803

SEQ ID NO: 12475 - DNA, 763 bp, Homo sapiens; identical to SEQ ID NO: 12461
  ENST00000638391

SEQ ID NO: 12476 - DNA, 376 bp, Homo sapiens; identical to SEQ ID NO: 12467
  ENST00000640147

SEQ ID NO: 12477 - DNA, 480 bp, Homo sapiens; identical to SEQ ID NO: 12468
  ENST00000638433

SEQ ID NO: 12478 - DNA, 785 bp, Homo sapiens; identical to SEQ ID NO: 12466
  ENST00000639220

SEQ ID NO: 12479 - DNA, 701 bp, Homo sapiens; identical to SEQ ID NO: 12464
  ENST00000638363

SEQ ID NO: 12480 - DNA, 447 bp, Homo sapiens; identical to SEQ ID NO: 12465
  ENST00000638474

SEQ ID NO: 12481 - DNA, 104 bp, Homo sapiens; identical to SEQ ID NO: 12460
  ENST00000638846

SEQ ID NO: 12482 - DNA, 5827 bp, Homo sapiens
  ENST00000393704
ttagcaggtctttctgcagggctgagctatcgctagggaacccacggtgactgaatcaaagggaagaaagacccaagacctggatctcccttttacatggaccctaaagcaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtgtggaa

SEQ ID NO: 12483 - DNA, 6318 bp, Homo sapiens
  ENST00000361618
ccgcgctcccggcagccggcggcgcagctcgcaacgctgtgaggcgccggcggaggcggctcgcccgcagtaggcgctaccgggcgtccggcgcagagtgcggcgcagcggccgctgtcgggctggccatggcgaggggtgcacggcggccacctgagtggcgcggcggtgtcaggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtgtgga

SEQ ID NO: 12484 - DNA, 564 bp, Homo sapiens
  ENST00000512698
gcagagtgcggcgcagcggccgctgtcgggctggccatggcgaggggtgcacggcggccacctgagtggcgcggcggtgtcaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggt

SEQ ID NO: 12485 - DNA, 550 bp, Homo sapiens
  ENST00000502832
atcgctagggaacccacggtgactgaatcaaagggaagaaagacccaagacctggatctcccttttacatggaccctaaagcaaaggtcctgtaggtgaaaaatgttgaagagcctctcactcagactgagtgaatatgagaagaactagatggaaaaggcatcctcactaccgatagcaaggtcagacagtgttaggatttgtgccggaacatgtgtgtgtacatggcatgcacatgcacaaaaaggcgttcaaaaatcatcggtgagtcactcaaggagcacactgccattcactttgtgattagcctggaaaggagcaatttcatgtctcgtttctgctgaaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcct

SEQ ID NO: 12486 - DNA, 551 bp, Homo sapiens
  ENST00000507601
gctgtcgggctggccatggcgaggggtgcacggcggccacctgagtggcgcggcggtgtcaggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctaatgatgattgtttccagaggaatctagtaatggactgaaaacgaaagagacgttttggtatccttgtcttccattggaaacaggaaattgctggcagagagagctgtgatgatctcatttaactagatggttacagctcatgctataggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggaga

SEQ ID NO: 12487 - DNA, 1505 bp, Homo sapiens
  ENST00000393702
gaggagaagaagccactaacattgcaggatcgtgtagcgaaacttctgtaggtacttaataattttagagtactctactttttaattaaaaaatcaacttatggttcattagaaaaaacgtggaaattacaaataatatttttaaagaaaatgaaaaaaaaattcctggaaccccaccactcagaaagtcaccagggaacggcccgctgggtttttttccagactcttccatctgtggactttgctttaagagacgtttaagacttacagcgcagtcgcccgggaaggcctgagaagctttcggaagcaaggtggtttgctcgtgattgcatttgattgcaaggagacaggagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggtaggctttaaagttgtatcaaatgtcataataaaatataaacaggagctttggagccagcacccgtgatgttagttcttctcatgcaaatgatttaaagatctcatcttgtcttgtttttctaaggcaggagagaatatatatccttaaggattcaaagaagcaattaattcatttttttccctcattgacacagaagacaaaggacaaacacagaagtctttttaaaggcttcttggaattttgtaatataatacatccaatacattatagagacaaatgtaaaatggattttcctaaataatatattcaatttttaagggagttttgttttctttcatggagatggctggaataaacaatatagccattgtttatcattaaatgtccatttaattcattggccgtggatttaaagaccacacttctgaaagaaacctcagtgcaagtctcagccactggctgggattcctggagacctggctgcagtttctaggctgaggcagggagggagggaggatgcaataacaaggaaggatgtgggacaacaggagactgcttggtttttaataaatgcatttctgaccaa

SEQ ID NO: 12488 - DNA, 548 bp, Homo sapiens
  ENST00000506110
agcctagaaaattacagtcgacttcatgagcttcatttggatttctcatcatgcaatagcaaagtcacagttattcctactgagatcacaatgatgctgccagagcctcccctgagcttgagagccctcctcttctaagcagcatttggaggttcttgctcaagtaccaactctatggacccaggacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggtaggctttaaagttgtatcaaatgtcataataaaatataaacagga

SEQ ID NO: 12489 - DNA, 667 bp, Homo sapiens
  ENST00000504999
gtaggcgctaccgggcgtccggcgcagagtgcggcgcagcggccgctgtcgggctggccatggcgaggggtgcacggcggccacctgagtggcgcggcggtgtcagagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagagga

SEQ ID NO: 12490 - DNA, 481 bp, Homo sapiens
  ENST00000506764
aggctcctgtaggtgggaagctccgcgctcccggcagccggcggcgcagctcgcaacgctgtgaggcgccggcggaggcggctcgcccgcagtaggcgctaccgggcgtccggcgcagagtgcggcgcagcggccgctgtcgggctggccatggcgaggggtgcacggcggccacctgagtggcgcggcggtgtcagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaa

SEQ ID NO: 12491 - DNA, 725 bp, Homo sapiens
  ENST00000510306
ccgtaatgtctggtgatgttccccagcctgtgggaggcagatgagattgaaaccagggtgtacatgagtgacctggagcccgtaagtaacagtaacacagagcagagagcgctagatgaggtggagctcagaggagcatgggaagttgaatgagacagtaaggagcattctggaagctataatgggtagttaggagaatgccagagtgattctgatgcagtccttccaaatgccggcagagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatc

SEQ ID NO: 12492 - DNA, 563 bp, Homo sapiens
  ENST00000514683
gcacatggcctgggcctttgggctccccactgtgaggcctctcacggtgggacccaggctttgggtagctggctccatgctctagcaaagcctcacttagcagtggggaggtcccaagaagagaagcgagatacccatataaagcaagcctgcttagccttccagggtccttcaaatcttaccaaatgaaagccagcttgctccacctactgtcaagccagcatctcattctccccattcttgtctcttaaacaactactcaaaaaaggagagccatgaaagtcaccagcctagaaaattacagtcgacttcatgagcttcatttggatttctcatcatgcaatagcaaagtcacagttattcctactgagatcacaatgatgctgccagagcctcccctgagcttgagagccctcctcttctaagcagcatttggagcatcctccattgtatagtgggaaagtggatatctggctttccttccttcctgaggaaattatgaacaagaagaacaaactccaagctaaatacaagtcacgacttttccagaatccaaaagtaaa

SEQ ID NO: 12493 - DNA, 581 bp, Homo sapiens
  ENST00000423098
gtctgcgcatcgcttaccgtggagccgttccagtgcgtgggccacgcgtccgcccttttccgcgtcacatgaccacgaacactcttccgctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtggtgagcagggcagcatttccttctcccactgctgctgagatggcagaaattagtcgaattcagtacgaaatggaatatactgaaggcattagtcagcgaatgagggtcccagaaaagttaaaagtagcaccgccaaa

SEQ ID NO: 12494 - DNA, 2004 bp, Homo sapiens
  ENST00000304593
gtggagccgttccagtgcgtgggccacgcgtccgcccttttccgcgtcacatgaccacgaacactcttccgctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaag

SEQ ID NO: 12495 - DNA, 820 bp, Homo sapiens
  ENST00000476924
gaccacgaacactcttccgctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctg

SEQ ID NO: 12496 - DNA, 639 bp, Homo sapiens
  ENST00000489696
cttccgctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacattttcagccctgtctttaaatttttctcccacagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactga

SEQ ID NO: 12497 - DNA, 2186 bp, Homo sapiens
  ENST00000353339
gctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaa

SEQ ID NO: 12498 - DNA, 1085 bp, Homo sapiens
  ENST00000354503
cagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttat

SEQ ID NO: 12499 - DNA, 560 bp, Homo sapiens
  ENST00000530359
agaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgtta

SEQ ID NO: 12500 - DNA, 584 bp, Homo sapiens
  ENST00000531278
ggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaat

SEQ ID NO: 12501 - DNA, 1548 bp, Homo sapiens
  ENST00000409565
ccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaa

SEQ ID NO: 12502 - DNA, 736 bp, Homo sapiens
  ENST00000452930
agcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggtgagtgttgacgtcttcccgacccgcgacctgccgcccgagctggctgccaggcctatcgccgccgccgagaccctccggccaacagggacccgcggtggccccggcccccccgggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaat

SEQ ID NO: 12503 - DNA, 1247 bp, Homo sapiens
  ENST00000409616
gcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaac

SEQ ID NO: 12504 - DNA, 3524 bp, Homo sapiens
  ENST00000460756
cgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttgtgagtaaaaatggtcccttttggcttactttcttagtctttaaatcgtctgcatgccaaatccttaaagatctatgtccccagagattttttgataaagaataaaagatgtgagttagcagtcatagtcaaaccagttgctggggctgagcgtcctgagcaacctctaagagctctcctaggcatctcagtgaggcgggggcttagggtggggctatatctccagcatggagtttaggaaataccttagccatggtaaagtcatgtatactgtctttaactttttatgtctttaatttatatatagtgtctttgctgaaaatttagtgtaatttccatttgaagtttaccctaaattttgaagtttatttttatttaaagaaaccattagacgtcaaatatgtaggctgcctcagttacatttactttttaccctttgtattcccttcatgatttattcatttgggcttagtcttaaaaaaggatttttcccctttggagtataatgattagaggagttttatggcagtattgttttcttcgaatctgacttcacatttgtatatacatttgatacagcttctctgtatcctgtttgcaaaatcataagacagtgactgtgcttacaactgtctttatgatttttgaggtatagaaaaactcttcttaggatagatttaacaattggtttctcaaatcaagccctaagccatgttcaaatccaaaagtcattttacgtagatatttacttttattcatagttttcttatgaaatgaattgttgaaatactgatttttattctttcttttttacagctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaaggtcagtgaaattttattcagttgagctggtattataggtttgagagacaatggctttaaagcttactgccgtaggctaaccatgctcttttacatttttatcagcttttgtattggcggcaacattctttctactgcattaaaaaaaaaaacacatgtaaatatgatattaaatacagattaatagtgtaaaactttcagtccctccaaaaatgaatacaaacatgaggatttattattacaaattctaaatttggtattcattgcatctcagtcattaggagaagttttagtttgtatgatgtgattttcagggagttgcatcttcttttttagtaaattcagagttaatgttatgcatctgtcatttaaaggttttgaataacagatgcatttgtcatttaaaggttttattttttcatgcatgacagtaatttttaattttatatttttaaagtccaagcagctttccctcaaattgatgaggaaattttaagtttaaattttattgcaggcatttttttagttacaagcagcatgcatgtttacgcagagagtatgtgtgtatgtgtgtgtacacatttgtgttgtaattctataataatttaaaaaatttgctcctaagcaatatcctcaaggtacaatttcagctgataattaagaaggcattttgttgaggaagacattttctttcatcttttatttttgctttgtatgtgttcagtacttgcaaatgagaagtttcctttcgctctttctataaggtattgtcttctaacttcactgcgtagaggagactgacattttaacagtcagccctgtctttaaatttttctcccacagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaa

SEQ ID NO: 12505 - DNA, 1760 bp, Homo sapiens
  ENST00000337110
gcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacacgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaa

SEQ ID NO: 12506 - DNA, 558 bp, Homo sapiens
  ENST00000525195
tttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcaggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaag

SEQ ID NO: 12507 - DNA, 597 bp, Homo sapiens
  ENST00000470090
tttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtgagtagaagcactagcattttatctcgtttgtaagttttctcaggatattttctgtacccatgtttttctaaataattacttcatgtagtttttaaaatttgttttacatcaattttatatttttgtaatactttttgtaatcttaaaatctggccattttgttggtcctgagaatttt

SEQ ID NO: 12508 - DNA, 576 bp, Homo sapiens
  ENST00000534203
tttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacacgtatggcatttcaaatatagatacaaccattgaaggaacgtcagatgacctgactgttgtagatgcagcttcactaagacgacag

SEQ ID NO: 12509 - DNA, 647 bp, Homo sapiens
  ENST00000524634
tttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagcc

SEQ ID NO: 12510 - DNA, 1716 bp, Homo sapiens
  ENST00000349901
cgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtattt

SEQ ID NO: 12511 - DNA, 527 bp, Homo sapiens
  ENST00000436237
actcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttgtgagtaaaaatggtcccttttggcttactttcttagtctttaaatcgtctgcatgccaaatccttaaagatctatgtccccagagattttttgataaagaataaaagatctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcag

SEQ ID NO: 12512 - DNA, 566 bp, Homo sapiens
  ENST00000443428
ttcccgacccgcgacctgccgcccgagctggctgccaggcctatcgccgccgccgagaccctccggccaacagggacccgcggtggccccggcccccccgggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaa

SEQ ID NO: 12513 - DNA, 720 bp, Homo sapiens
  ENST00000418961
ccgcgacctgccgcccgagctggctgccaggcctatcgccgccgccgagaccctccggccaacagggacccgcggtggccccggcccccccggtagtgtctccctgacccgagtcccgtccccgggcctcttgccttcaaccctggtctttcctcctccccgggaccttgagtccccgaggagagcgagggagaggagcgtcttctgcagggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagca

SEQ ID NO: 12514 - DNA, 726 bp, Homo sapiens
  ENST00000436791
atatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacacatgtaatacacattggatgacatttagcctgatgttagttttgccttgacgttgagaatgttgagccctcattccactgtcgtagtcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgca

SEQ ID NO: 12515 - DNA, 729 bp, Homo sapiens
  ENST00000456345
atccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagt

SEQ ID NO: 12516 - DNA, 1653 bp, Homo sapiens
  ENST00000490857
cttcaacttcattggctttacgaagtgtttgaaatggtgtttttatggaatcacacttttgattcatgtgtttaaactttgacatctgtatgtgagaattccctgtcctactcttctaatcatccataagtcgacagcagtgttgtttcttagaagttggtttattgaattggaatataaacacgaagtaaagaatgctgcttctccatgggaggggttgaacacattcattgctgtagttctcttccctctctacagttctttcatattcagtttatttattttgatgtttagggttacaaagttataagtgctgccttgtagctagtttttggaaacaattcaaaatatttattctttgactgttttcttgtggggagagtgaagggtgggaaaggggcaagaacactaagaaaattaagataaagactgctcagctgaagttttataaaaatctgacttgagtgtttttctcttcatttgctgtgcttgtgtaaacagtgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaa

SEQ ID NO: 12517 - DNA, 1824 bp, Homo sapiens
  ENST00000476262
attttaaaagataaaacgtattggaaaggttactgcttatcaaagtagaaagctaactgtcctctagcgccaaagtatatactgagaatgagtggaaatccccaccaagtttcccattgcaccttagtcttcatttccagcagccctgtatgtcactcctggctgtctcaagatcagactcaaattgtggattgcccttcctgtaatgtgctctagcacgtctcctgatctcagcttcagagtggaggcttgcattttcactctggagagctgagagtttgaatgagacacagctgcaacgagacatcaggcactactcaaaattaatgaggtgggagggaaggaagtgtgggaaatggagtttcttgaaatttatgaatacggtttttgagatagagctgttgatatcagatgagcaactgtggtcataccggtgcagctaaccaggtcctgatatgcttttaaaggtgctagtgattttttttttccaactggaagaaaggaattacactttttaagcagagttgtcctctgtcttaaatttcataaagtaaagcaccaagaaaattattttatatgttggtgctgttttgtcgtgtaaatatagattccctttgtttctttgatcaatagtaatgttgagtttatgaaaatgataaaatggaggacacatgagacaaggattttttaaagtagttgagagatattatattgtattgaaatatacaatataatcctatttgacatttatttgtcttgtttttgcttttattttattacttctctgtttcctgattctgtcttgtgccttctcccgcaaaaacctgccttagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaag

SEQ ID NO: 12518 - DNA, 660 bp, Homo sapiens
  ENST00000477362
atatggacataagtttgtgtaagaattatattttgttctatcctaagtggcagctctcaaaccttttcagccagggaccctttttagcatcgccaatccttctggcttgagaattttctatgtgtttctttagtcaggatttttttcccattctccagtttttagtgccctttttcaatattgtagacagttgtcattttaagcttttttctttcctttattagtacaaattcaggtagtaaaatattttagtaattcatattattaagtaccaattttctgaatactactttgagcattacacaaagcatgatgtggcgtgccatttactctgagttctactttactattcatttgtatttctatctcttatctgcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttc

SEQ ID NO: 12519 - DNA, 1710 bp, Homo sapiens
  ENST00000392059
ggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaagta

SEQ ID NO: 12520 - DNA, 1989 bp, Homo sapiens
  ENST00000558018
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggggtgatgtggccttttccagaaggaggaaacaccatacctatcttacacacagatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacgggaa

SEQ ID NO: 12521 - DNA, 1752 bp, Homo sapiens
  ENST00000268151
ccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagct

SEQ ID NO: 12522 - DNA, 1937 bp, Homo sapiens
  ENST00000268150
tgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagc

SEQ ID NO: 12523 - DNA, 1689 bp, Homo sapiens
  ENST00000566497
ccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcag

SEQ ID NO: 12524 - DNA, 801 bp, Homo sapiens
  ENST00000560937
ctgtgaggagctgagcccggctggttgaggtgaggaggtggtggggtcggcagtgagaaggtcgcacagttggccctgcaaggcggatggagctgctttctgttgcccaagagcatgacaggggctggtcaggatccacagagttctttctgcttcatcgccttgtgctcctgcccctgggagctgtggatcccagatccagatgacagcccaccttgctggcaggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactgggg

SEQ ID NO: 12525 - DNA, 1172 bp, Homo sapiens
  ENST00000542878
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccat

SEQ ID NO: 12526 - DNA, 849 bp, Homo sapiens
  ENST00000558029
gagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacgcagctacaagacctggggcttgcatctcttcagctggaacccctcctatgcacggctggacaagcagggcaacttcaacgcctgggttgcggggagctacggtaacgatcagtggctgcag

SEQ ID NO: 12527 - DNA, 2464 bp, Homo sapiens
  ENST00000617199
ttgccttctgctagaaggaaatgtaggctactgggaaaggacagagccaggtctgtgtgcctctccctggagtccctgacacttgctgttttggcttgaagcctttggccattaaagttgcctgtatccaggcatgactggcccctgctcagggccaagagagggtgagtcttgcaaaccaaggaagcccaggtaccctgtctgcttccttcagggtctggaccactcctttccctataggccttccagtcggctggagagtgttggtgcatgtgtgcatgtgtgcacgtgtgcatgtgtgtgggtggggctgaggtctgggggtacctgggattccacaagggattcctctttgcagacatatggtgtctttggtaaattaattatttaattcgatggatgtttattaagatattgattaagcccctcctgggtgcttggctctagggaatgattccttgacctcatgtaatttgcattgtagcaaggaaggcagacttgaggcgaggagcagatgacagagagcagtaacagctctgaagaaaagctagaggctgatgagatgaccatgacttggggtgaggggagagagcaagacaaggactgctctgtcgggaaggcctttgactgggggcctgaatgatggagagccagccacatgaaaaacttaaaaacagcactgcaaaaagagcactgcaggcaaggaattggtaaatgcaaaggccctggggcatgttgaagggtggaaggaaggccagtggagctggagccaagagatggaggggcagcttggtgggtgaagagccccagggacccgcagtgtcatcacctaggagcttcttagaaatgcagactgaggccgggtgcggtggctcacgcctgtaatcccagcactttgggaggccgaggcgagcggatcacctgaggtcaggagatcaagaccagcttggccaacatggcgaagccccgtctctactaaaaaaatacaaaaattagccaggcgtggtggcaggtgcctgtaatcccagctactagggaggctgaggcaggataattgcctgaacccggtcagaaggtggaggttgcagtgagccgagatcatgccactgcactccagcctgggtgacagagcgagactgtgtctcaaacaaacaaacaaaaaaacaaaaaaaaagaaatacagactgaaagccccagcctagacttgctgaaacataagctttttttttttatatcaagatccccaggtgatctgtgagaattactcccctagtatctcattttatagatggggagactgagagccagagagaggaagggacttcctagagtgctggagctgacagtcctgtccctgccctggtgccccttccaactgcattttaccagaaaggctgtctgacttcctggggaggctgagagtgaggagggtatgaaccactagaagcagatgatctgtagaggggtctgcgttgagcacattgtgcagaattggtgtcctctgcaaagctgcccaggttttagcctgcctcaggcctctcctcttctggggccaagggacaaccagctctcagcccgggagcctctctttgagggggaaggtggtggttccctggtgcatcaccatcaggagatgatggtaccatcagcaggcattgtcaacacaccctggaggcaaatgtcttgagtggtgagagtacaggtgggcagtgatataacttagctggctcccagtactcttgagtggtgagagtattggagggcagtgatataacttagctggctcccagagggcagggggctctccagtcccaccgtccactcctgcctccctcaattccccagagggatagacacttgtggagtgaggattcttccaggtgggagacacccccatcattctcttgggagttgtatctcttgcccatccccaactgttctatccatatgcaggtgcagatacaagtgcaaggcagcccggcacattcctgagtgtttggggcagggctgagtgaaacaaaggccagcttcccgggccagccctcacaggcctgtgtgacagcatccccagaacatttgagtgtgcgaaggccctctgggagacactaagtcagggggcttctggggaatggaaatagagatgttcctgtgccccaggagttgtctgatttctctaactgccagctgctggagggcagggatgttgtcctgttcatcactgggtcgtcactaggcaggccttcatcatctagctgggatgtgtagctggtagaggtgacgtcatagtgtgacattaggagtttgtatgtgacttgagcatgatgcttaatgtctttcagttttctcatctatagaatgggcttactaatttctacttcatttagtgtttttttttctttttttttttggtggcaggttaaatgactgaagtaagcactgaataaacaatgtggttgttattaaa

SEQ ID NO: 12528 - DNA, 456 bp, Homo sapiens
  ENST00000613965
ttcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacgcaaggaaggcagacttgaggcgaggagcagatgacagagagcagtaacagctctgaagaaaagctagaggctgatgagatgaccatgacttggggtgaggggagagagcaagacaaggactgctctgtcgggaaggcctttgactgggggcctgaatgatggagagccagccacatgaaaaacttaaaaacagcactgcaaaaagagcactgcaggcaaggaattggttaaatgactgaagtaagcactgaataaacaatgtggttgttattaaa

SEQ ID NO: 12529 - DNA, 500 bp, Homo sapiens
  ENST00000560553
gctggccatcagtggaactgtagggctcgctaagcagagctgcagagtggagacaccacccaaatacccctcagagctgagttcagtgcctggctgggttcagtgtttttagtatgaacttgagtagcaaggaaggcagacttgaggcgaggagcagatgacagagagcagtaacagctctgaagaaaagctagaggctgatgagatgaccatgacttggggtgaggggagagagcaagacaaggactgctctgtcgggaaggcctttgactgggggcctgaatgatggagagccagccacatgaaaaacttaaaaacagcactgcaaaaagagcactgcaggcaaggaattggtaaatgcaaaggccctggggcatgttgaagggtggaaggaaggccagtggagctggagccaagagatggaggggcagcttggtgggtgaagagccccagggacccgcagtgtcatcacctaggagcttcttagaaatgcagactga

SEQ ID NO: 12530 - DNA, 611 bp, Homo sapiens
  ENST00000559259
cagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggtgagtgctgggggtgcgggtaggggggcactgttggccaatcctaggaggtggccctccctgctgcctcttttctcagccaaactgagctaggtagggcagcaacaaggcacggggaccaggcttcactcgggcaacgcactctagggggtcacctggccatagcagccccacccaggtgtttgctgtctgccaacccatgacccagggcattctgattgatagagaaaaagacatcagttttcaaagtattttcccttcttctggttggctcctctcctgtagcttctagaacatgtagcgttaggtgtgtttggcagatgtcagctttacgagggcagagaatctgtctgttttgtttgcttcggtattccc

SEQ ID NO: 12531 - DNA, 531 bp, Homo sapiens
  ENST00000559997
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgtttgctgtctgccaacccatgacccagggcattctgattgatagagaaaaagacatcagttttcaaagtattttcccttcttctggttggctcctctcctgtagcttctagaacatgtagcgttaggtgtgtttggcagatgtcagctttacgagggcagagaatctgtctgttttg

SEQ ID NO: 12532 - DNA, 1031 bp, Homo sapiens
  ENST00000558352
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggtaggtcttgttggggcccgaaagaagggctgtggtccataccccctaaggttctagcattgactgaggacccccagcgagtccagagaaccctaggtgattggctatgatgtgggtcttcgggtgcatcttggcttctagaaattgggaaacccagactgtgtccatgttctgtggtttataagcaatagtcccactttagagatgagactagtgagattcaaaatggcacagtgacctgttgagggtgatagtggtggtggagctgggtttcattctgagccttcatgggtacatgtacagttgtgtaggttgtacactgctcaaggatgtcattgctaagcaggcaccattcacagtacaggcattgtacatttgtggaactctgtcagaaaattgtcataataaactatttgagaaaggagtgccttttcctaatttgcaaagaggtaccctgtaggttacaggtggccctgtgtcagctataggggtttatgcccaggctccatgatgattaaggaaagtgagaggagaatctttgtggagggccgtggggtggccaa

SEQ ID NO: 12533 - DNA, 680 bp, Homo sapiens
  ENST00000559770
tgggccgattcgcctacacatggacttccttggctctaggcggactcaggctccatccagcacacgggggaagagggagaggaagagataatgggcgagtttgagtggagggtccttttgggctggacccatctgctacttctcacctgtgtccccagctccttcctgatcatctgctcatcttacctgtctctgtccccagatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggtaggtcttgt

SEQ ID NO: 12534 - DNA, 358 bp, Homo sapiens
  ENST00000559143
tgcctgcctctccagaccccagctgccagctcttccaccagtgggcagtggtccccagcaccactgccattgtcagccagcacttttctggacactcccaggccacttggaaagctgggcgcttcccttatgtgggccgattcgcctacacatggacttccttggctctaggcggactcaggctccatccagcacacgggggaagagggagaggaagagataatggatatctgttccaaaaacccctgccacaacggtggtttatgcgaggagatttcccaagaagtgcgaggagatgtcttcccctcgtacacctgcacgtgccttaagggctacgcgggcaaccactgtgagacga

SEQ ID NO: 12535 - DNA, 534 bp, Homo sapiens
  ENST00000558773
gccgcgcccccgcctgctggccgcgctgtgcggcgcgctgctctgcgcccccagcctcctcgtcgccctggacccagctcaaatattccctcctctggggaacttctaattccccagcagaaatcatgcctccagtgacggtccatgcaggcttctggagcgttgggcaatcttcctcatctgtggacttgctggcctctttccccttggcttcttgaggcctgcgctgcatctgatttctctgtctcgggggcctagcatggtcattggccctcccagtgtttcctggatgatcatcgtgctgttcctgagtcagggctgccattggaggtgacatctgtgactgcaacctgtgcctgaattggtgggcggaacctgctcaatgggccagaacaatgcttccttccactgcccctgcctgaaagtcctcatgggcctcctttgcaatcaaactgctgccaagagacctgccctggaccttgcctgcctctccagaccccagctgccagctcttccaccagtgggcagtggtcc

SEQ ID NO: 12536 - DNA, 435 bp, Homo sapiens
  ENST00000557944
gagcagcccagcgtgcccattccagcgcccgcgtccccgcagcatgccgcgcccccgcctgctggccgcgctgtgcggcgcgctgctctgcgcccccagcctcctcgtcgccctggtgggatttctgcatttcagccagagggacctgtctgcagctaccagatgctccccaccctgggagagctcagcggcatgtctgcacatgggccttttcagccttcttcatcccgcaattggaactgactttcccactcccatctcacacttgagaatctctgtttcttgtttcttgttttttattttatttttattttttctcccccctggtggacaatggtgaggagggtgaaggaaggttaaaagccactgctctacgggatgaaaaactaaacttgtcattcttcagatccctcccagtctggccccagcctaccc

SEQ ID NO: 12537 - DNA, 6414 bp, Homo sapiens
  ENST00000276282
ccggcgggcggcgctgccgcttcccaatcgcgccctcccagcgccggggacgcggcgcccgcgctcccgcccgagcccggggaaacggagacaaggaggcgccgccgccccctccccgcggctgcgccccagccctgcgcccgcagcatgcccgccgccgggccgagcgccgccctcccccaggagctcgaggaggcgacgccgctgccggccgcgggaccgcggctgcgagggtagcggggccggagccgggccccccgaggcgccgcgcggcgggcggagagggaggaggagcaggcatcctccgcggcgcgcgggcggcggccctgctgcccggcgcgcccatggcccggccgcagggagaatgcaagctgctctccacgcgctcggcgtcccccggagccgctcgcgtcgccgccgccccctagccgccagcgctcggccgctggctgcgctaggacccgcggccgccggccgccgagcgcgggagggcaggcaggggcaggagccggagggcccggggcgcggcgcggcatgtagctgcgggctcccgcgtccgcgtgaggctgtcggcccggggccccgccatggctgggatggacagtggcaacctgaagaccgcgaggctgtggcgggacgccgccctgcgtgccaggaagctgcggagcaacctgcgccagctcacgcttaccgccgccggggcctgccccggggccggggccgacgcgctcgagtcccccgcctccccccagctcgtgctgccggccaacctcggggacattgaggcactgaacctggggaacaacggcctggaggaggtacccgaggggctggggtcggcgctgggcagcctgcgcgtcctggtcctgcgcaggaaccgcttcgcccggctgcccccggcggtggccgagctcggccaccacctcaccgagctggacgtgagccacaaccggctgaccgccctgggcgcggaggtggtgagtgctctgagggagctgcggaagctcaacctcagccacaaccagctgcccgccctgcccgcccagctgggcgctctcgctcacctggaggagctggatgtcagctttaaccggctggcgcacctgcctgactccctctcctgcctctcccgcctgcgcaccctggacgtggatcacaaccagctcactgccttcccccggcagctgctgcagctggtggccctggaggagctggacgtgtccagcaaccggctgcggggcctgcctgaggatatcagtgccctgcgtgccctcaagatcctctggctgagtggggccgagcttggcacgctgcccgccggcttctgcgagctggccagtttggagagcctcatgctagacaacaacgggctgcaggctctgcccgcccagttcagctgcctgcagcggctcaaaatgctcaacctctcctccaacctcttcgaggagttccctgccgcgctgctgcccctggctggtctggaggagctctaccttagtcgcaaccagctcacctcggtgccatcccttatctcgggcctgggccggcttctcaccttgtggctggataataaccgcatccgctacctgccggactccatcgtggagctgaccggcctggaggagctcgtgctgcaggggaaccagatcgcggtgctgcccgaccactttggccagctctcccgggtgggtttgtggaagatcaaagacaacccactgatccagcccccctacgaggtctgcatgaaggggatcccctacatcgcagcctaccagaaggaactggctcattcccagccggcggtgcagccccggctcaagctgctcctgatggggcataaggctgcaggaaagactttgctgcgccactgcctcaccgaggagagagtggagggatgcccaggaggaggggacaaggagaagtgctacccaccgtcacctccccctgtgagcaagggcatcgaggtgaccagctggacggccgatgcctcccggggcctgcggttcatcgtgtatgacttagctggggatgaaagttatgaggtgatccagcccttcttcctgtccccaggggccctatacgtgctggtggtcaacttggccacctatgagcctcgccactttcctaccaccgtgggctccttcttgcatcgggtcggggcgagagtgccccacgcggtggtgtgcatcgtgggcacccacgcagacctgtgcggagagcgtgagctggaggagaaatgtctggacattcaccgccagatcgccctgcaggagaagcacgacgcggagggactgagccgcttggccaaggtggtggacgaggcactggcccgggacttcgagctgcgctctgccagcccccacgcagcctactatggcgtttcggacaagaaccttcgacggcgcaaggcccattttcaatacctgctcaaccaccggctgcagatcctctcccccgtgttgcctgttagctgcagggacccgcgccacttacgacgccttcgggacaagttgctgtcagttgctgagcaccgagagatcttccccaacttacacagagtactgcctcgatcctggcaggtgctggaggaactgcatttccagccacctcaggcccagcgactgtggctaagctggtgggactcggcgcgcttgggcctgcaggcgggtctgaccgaggaccgactgcagagtgccctctcctacctgcatgagagcggcaagctactctactttgaggacagtccggctctcaaggagcacgtcttccacaacctcacccgcctcatcgacatcctcaatgtcttcttccagagggatccctctttgctgctgcataagctgctcctagggaccagtggagagggcaaggcggagggggaaagctccccgcccatggcgcggtccacccccagccaggaactgctccgggccacccagctccatcagtatgtggagggctttctgttgcatgggctcttgccagctcatgtcattcggttgctgcttaagcctcatgtccaggcccagcaggacttgcagctgttgctggagctgctggagaagatgggactctgttactgcctcaataaacccaagggcaagcctttgaatgggtccacagcttggtacaagttcccatgctatgtgcagaacgaggtgccccatgcagaagcctggattaatgggaccaacctagctgggcagtcttttgtggctgagcagttgcagattgaatatagctttccttttacttttccacttgggttgtttgcacgctacagtgtccagatcaacagccatgtggtgcacaggtcggatggtaaatttcagatctttgcctatagagggaaagttcctgtggttgtgagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccaggggagttgctgagtcagcccagaccggaaggagtggcagagatcatttgccccaagaacggcagcgagcgagtaaatgttgccttggtttacccacccacgccgactgtgatcagcccctgttccaagaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggacgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaaatctctctgttagcccatggattaagtgttggttcatagagattgccaataatcagaaagaaccttaaatgtgcatttaagacagtgtcccttcccttcttttcaatgaaggtccctgcctatataaatcatctggcacgctggtgggaaatcctttgctcttccaacgtgttattagtgctgggcagagatggggcacactcaggggccaaagaggacaaaaagtccatgcaaaacttgagtcttttaatggcttaagataatcaggagtcagttctgaatcttacaaagtgctctgcttaataagtaccttacttagcagagcactttgcaaacatattacttattagcagagctctttgtagaccttccacatctggctgtcagatcttaaggttgtgaatttaggctccagttacattcactggagagcataatcccacacgggttatttataaatacagagcctctgattggacggtctcctgccaagaactagtaatacccttgttttaaaatcttcacaaggtaaaacttaaaaagccaaccaaacaaattgctctccattctacttttaattgggccaaacagcatatgctacagtagtaacatgtttttcggagagtgtaaaaaactctgtttacatttgcctcctccgtgggttgatcgaaaatgtataaaactgactgcttctcgccagcctcagacaagaagagtgagttgctggtactcgctactcttttacttcttttgtaaagtattgactcttggaaggctacagtatacaaagtctcaacatgttttttaaaagaaataaggagcaagcgactgccctgctagaaatcacaaaccgatttttgtagaatattttgtgccccaggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagattaatctggtgaatccttttgtcacagttctcgtgtgtgtgtgcgcgtctccgtgtgtgtgtgtgtgcatgtgtgtaaaactgaatggtcacatttaattgctttttggaccattgaatagttgggaagtaagaattttttaattggcatgagacggttcctcaactgttaaattaaccaactttgacctgtctttagaaaaaggcttatttgtatgattttgggctaactccccggggaccatattaaatgacaaaaatgctcctttgggtgacacaccctacaaagtatttgctgttacgaacataaacgcccacattcttaatatctaatatttttgaccagtgatgttttatgctgtcatctgaaccctagagaagcagtgtcagaggaaaccttggtgtcacatgtgtcttagcaaaagggttaccatgatcgagggtcatgtgaccaaaagatgctccagagaagcttgagaatttgtttcaagttgggaggagggttggagatacaaaaatcactctgctctacaggactcttcagctgtctatgcaagaaattccgttttctctttcagcacctggaaagacacagcagcccaccgaggcgataggtgattcactaagcacaagaggaatgttttctaagcaaggcgtcccttgcctctcaaacaaatgccctccaagtttgttagggtttctattcctgcaacttgtggtatcaaaaccacttcctggaattgtcaaagcactgccaaaataaatgtttttcccccttctaagaaaaaaaaaatgacagtgctcatatttgacacttgtgtattggactctcttttgaatgaataaaaaggaaaaggggtttggtgtaattcctgatggggtgcgtgttgtttttcatgccatggtttgtgaattttaattgtggtttcccatttcgttgttgtaactgggcagaaattaaaaaagaaaaatcaataaaaatacaaagaaatggttaaa

SEQ ID NO: 12538 - DNA, 577 bp, Homo sapiens
  ENST00000521881
agccagccaaatgtgtttcagatcctaaatcctccacctaaggggagttgctgagtcagcccagaccggaaggagtggcagagatcatttgccccaagaacggcagcgagcgagtaaatgttgccttggtttacccacccacgccgactgtgatcagcccctgttccaagtatcttcatactttcttggaaaattaagtggaaaagatagtgcttcttttccttatgccatcatttttactgtacccaaactgtgactttaggagcaccaatttttaagggaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggacgactggggaagaggtggggagggggtggtggggggaagcatggacgagaacatggagcaaatgttttacaacctgaacctcagaactgtgatcctccaaggagcgcgctacttgaaga

SEQ ID NO: 12539 - DNA, 444 bp, Homo sapiens
  ENST00000520715
ccacagttaatcagtgatttcctcagatgtccacatgctcctacggggagttgctgagtcagcccagaccggaaggagtggcagagatcatttgccccaagaacggcagcgagcgagtaaatgttgccttggtttacccacccacgccgactgtgatcagcccctgttccaagaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggacgactggggaagaggtggggagggggtggtggggggaagcatggacgagaacatggagcaaatgttttacaacctgaacctcagaactgtgatc

SEQ ID NO: 12540 - DNA, 585 bp, Homo sapiens
  ENST00000520091
agaggaattggctgcccgtggccgggtggagagtcctcgtcttgtgtgtggccagggtctcaaggcctcatgctacacacttgcgtatagcatctcgtgcaggcttcaccacagtcttacgaggcatgcggtgaccttgcccttagacgtgtgcactcaggcctagagctgtcagagccatttgtcgagcgacccgctgctaggagatggcagagctggagccagaccccaaagccagcgctgcgctgttctccttttgacgcgggcttatccacagttaatcagtgatttcctcagatgtccacatgctcctacggggagttgctgagtcagcccagaccggaaggagtggcagagatcatttgccccaagaacggcagcgagcgagtaaatgttgccttggtttacccacccacgccgactgtgatcagcccctgttccaagtatcttcatactttcttggaaaattaagtggaaaagatagtgcttcttttccttatgccatcatttttactgtacccaaactgtgactttaggagcaccaatttttaagggaagaatgttggtgaaaagcacagaaaccag

SEQ ID NO: 12541 - DNA, 2154 bp, Homo sapiens
  ENST00000372811
gagggggcgtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtt

SEQ ID NO: 12542 - DNA, 946 bp, Homo sapiens
  ENST00000434861
gagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagag

SEQ ID NO: 12543 - DNA, 2173 bp, Homo sapiens
  ENST00000372809
gcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcagaaggatgaggaagttgtcttttgcttctcctcattccaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtt

SEQ ID NO: 12544 - DNA, 1929 bp, Homo sapiens
  ENST00000483824
cgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtt

SEQ ID NO: 12545 - DNA, 923 bp, Homo sapiens
  ENST00000469745
tgactaccggggctcctgcaccagctgtcttctctgtgtagcatctaacttggcaagcatcgcatcttagttgtatccatttacagagggggaacactgaactccagaaggaacaaaaaacttcagcagctaatttttgagtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatg

SEQ ID NO: 12546 - DNA, 2432 bp, Homo sapiens
  ENST00000480630
ggtatatataacttttaaattatgtcaacttttctgtttgccaactagtatgtaagttccacaagggcaatgattttttatctgttctctagttatcctaagtaattagaatagcgcccagcccatagctggaacttatgaggaaatgaggaaacgagcttcagataatttaaataacttcccaagactaagttttatagttagttggtggagctagaatggaatccctgaagagtggctcaaaggcctttctctttaccatggcctgtgctgccttgctatactgatgccatgaagttagtccatcctgaggtctaaccccttttgatggtgtggaactcacatggggaaggcggacatttgcccacctgggccttcaactccttcacttggagctggcctctccccatcatgccagcttccctgtgtgtgaatgggtgtgtgtgtgtgtgtgaatggggtgtgtgaagtgtgtatgtgaatgggggtgtgtgtgaatggggtgtgtgtgtgtgaatgatgtgtgtgtgaatgaggtgtgtgtgaatggggtgtgtgtgtgtgtgaatgaggtgtgtgtgtgaatggggtgtgtgtgtgaatggggtgtgtgtgtgcggttgatgactatccgtgtgagaacacgggagttggggctgctccttctctttgcctccttgcccaggcacctgaggtcttggactcctgtcctaactctcagcccattagaggctgctgcctctggactagactcaggctctgacctcacactccatgcctaggatttcagtctggggtcccagttcccatctgccattccgggcttggtcatcagcctcttcccagaggcccaggatgggtggatttggcaggagtatggggaaggaaggaagagcttagcttccttccctgtggggaccctgtgaggcacagcagactgggctgggcctggtcctgggctccagcctccagcctccactcacaccctcctcttcctcaggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtt

SEQ ID NO: 12547 - DNA, 793 bp, Homo sapiens
  ENST00000491515
tcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcagtgagtggggttgaagagcagagcctgggttgagttgggatgtctggtgggaacctcccagctgattcatcttcctgcacccccttccctagtcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtac

SEQ ID NO: 12548 - DNA, 683 bp, Homo sapiens
  ENST00000459917
gtgcctgtcatcttcgttgctgcccacatgatgtcatctggctgctcttgggcagggctgggagccactttggggttctgggaagggcaggaggggctctgtggctctaaagcacctccctttaaccccctttgtccatccacagctctcggccactttaaccattcccatctggcagtggttcttgacccggtttggcaagaagacagctgtatatgttgggatctcagtgagtggggttgaagagcagagcctgggttgagttgggatgtctggtgggaacctcccagctgattcatcttcctgcacccccttccctagtcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcct

SEQ ID NO: 12549 - DNA, 905 bp, Homo sapiens
  ENST00000481612
catccacagctctcggccactttaaccattcccatctggcagtggttcttgacccggtttggcaagaagacagctgtatatgttgggatctcagtgagtggggttgaagagcagagcctgggttgagttgggatgtctggtgggaacctcccagctgattcatcttcctgcacccccttccctagtcagcagtgccatttctcatcttggtggccctcatggagagtaacctcatcattacatatgcggtagctgtggcagctggcatcagtgtggcagctgccttcttactaccctggtaggtatatacaggcccccctcctcgggtatctccagcccctagtccccagttttgaagctccttagggagagttctatgcagtgttctcccacaggccattctgtgggtccaggttaggagtgggggaggtctgtcctgtacagttgtacaggtagtgagctttgcaagaacacctagtcagagtgaaaaatgggggctgtaatctggcctgggctccacttgccacgctgagcacctccaggcagggttacttcctcttagagcaagaggccttttcttattcatgtgaaggtcccatatcctcactgagctgtgtacccatggtactgcaagcttccagagggccacctcttctcattaacacagaggcccgttaggtgggtcagtcctcatggctgtcactactctgcgcaggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtc

SEQ ID NO: 12550 - DNA, 1914 bp, Homo sapiens
  ENST00000420632
agaactataagaggcgcggagggggcgtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaaggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtttc

SEQ ID NO: 12551 - DNA, 347 bp, Homo sapiens
  ENST00000496253
gttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaatctgctcaattgaca

SEQ ID NO: 12552 - DNA, 4049 bp, Homo sapiens
  ENST00000258436
aggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgtgtcttgtgttaagaatcatttcctggccaggctcggtggctcaggcctgtaatcccagcactttgggaggctgaggcaggtgaatcacttggtcaggagatggagaccattctggctaacatggtgaaaccccgtctctactaaaaatacaaaaaaaaaattagccgggcgtgatggcgggcgcctgcagtcccagctattcgggaggctgaggtagaatggcgtgaacctgggaggcggagcttgcggtgagccaagattgtgccactgctctccagcctgggcgacagagtgagactccgtctcaaaaaaaaaagaatcatttcctttatttttagtttcacgcctgcaaacacaagcattctgttgatcaacggaaatattttgatgtgccatttcttgtctaaacaagtttcatatacagcaccgagggggccacgagaggcagaggcccagacagaaggtgaacatagccttgcagggagacatatgccaggcaggatgaccattgggattgcatcaagtattaatcagttacttaagggcttcctgtcagacagttgaagttcacattccttttacttttcttaattagtccactaggatggtatgcctgttttcaacttaacacatgcatacttgtaaatattttagtatgctacagtaatttgtcatatctttaatatttattgtttgtaaagcagtaaacatttctgtattttagaagtcatggagtaaaatcaaatatttatgataaataattggaagtatgttttagtttgaagattgtcctttttcctatcttgctgcaaggaaaaatggacttctgattaggttttacaattgtgaacttttatgtaaatgttaagtgctttcgaggagaccaaactattattaatatataaaatggccttgcccttaaggagcaaattaaatctcatggagattagactcaaaaggcaataaataatcgagggtttatgcaatgaaatagaatttcagaagagtttggatctcaaagattgtccttcactctcagaaacaggcaagtttcttaaaagcccttatagtcgtgtttttattttaaaaatcgtagcactttatttttgaagtttaaaaagcccataaacttaatgagtctttataatcagacacatggaaatatagaaaaccaaagactgatcttagaatatagagtagagagacatgtttgttattctccactagtgactttagtattttgttatgtgatgttttttaggtgcaccttttctcatgactccttttactttatctaatgtcttcctctttaaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaatctgctcaattgaca

SEQ ID NO: 12553 - DNA, 2990 bp, Homo sapiens
  ENST00000438943
ggggcggggctgggctcccggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtagacgacgtatgttcaaagagattttgagatttgagcactataaccaagtcccatgccactagtggcaacaggtacttatggagcctctgcaaggagctggctgtgtgtataaaagggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgtgtcttgtgttaagaatcatttcctggccaggctcggtggctcaggcctgtaatcccagcactttgggaggctgaggcaggtgaatcacttggtcaggagatggagaccattctggctaacatggtgaaaccccgtctctactaaaaatacaaaaaaaaaattagccgggcgtgatggcgggcgcctgcagtcccagctattcgggaggctgaggtagaatggcgtgaacctgggaggcggagcttgcggtgagccaagattgtgccactgctctccagcctgggcgacagagtgagactccgtctcaaaaaaaaaagaa

SEQ ID NO: 12554 - DNA, 2440 bp, Homo sapiens
  ENST00000437075
ggggcggggctgggctcccggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttgcatggttgtgcctttattgagccttcatgtcaagtcccttggagcaagtccaacagttgctggaatagtagacgacgtatgttcaaagagattttgagatttgagcactataaccaagtcccatgccactagtggcaacaggtacttatggagcctctgcaaggagctggctgtgtgtataaaagggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctc

SEQ ID NO: 12555 - DNA, 1183 bp, Homo sapiens
  ENST00000411991
ggggcggggctgggctcccggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtagacgacgtatgttcaaagagattttgagatttgagcactataaccaagtcccatgccactagtggcaacaggtacttatggagcctctgcaaggagctggctgtgtgtataaaagggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacg

SEQ ID NO: 12556 - DNA, 576 bp, Homo sapiens
  ENST00000428085
acagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgc

SEQ ID NO: 12557 - DNA, 548 bp, Homo sapiens
  ENST00000421966
gcttccgctcggggcggggctgggctcccggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggtgagtgcgagcgtgggggctgggagcaagtgctgactgtgttcgggcctggggacccaggcggttcttggagcttccggggagctcccagggagtgggaacccgcagtccgcctggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactc

SEQ ID NO: 12558 - DNA, 335 bp, Homo sapiens
  ENST00000462099
gctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttgcatttattttgttttaggatttgtttggtgtcagcatggttgtgcctttattgagccttcatgtcaagtcccttggagcaagtccaacagttgctggaatagtaggtgagtggtcgatattgctcatttttagagcactga

SEQ ID NO: 12559 - DNA, 5062 bp, Homo sapiens
  ENST00000341184
acggggtggaagtgggggtggggggaggggatcggggccgggccggggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatgggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggccgaggcgcccggcgcaagtgggtggagtgcgtgtgcctgcccggctggcacggacccagctgcggcgtgcccactgtggtgcagtactccaacctgcccaccaaggagcggctggtgcccagggaggtgccgcgccgcgtcatcaacgccatcaacgtcaaccacgagttcgacctgctggacgtgcgcttccacgagctgggcgacgtggtggacgcctttgtggtgtgcgagtccaacttcacggcttatggggagccgcggccgctcaagttccgggagatgctgaccaatggcaccttcgagtacatccgccacaaggtgctctatgtcttcctggaccacttcccgcccggcggccggcaggacggctggatcgccgacgactacctgcgcaccttcctcacccaggacggcgtctcgcggctgcgcaacctgcggcccgacgacgtcttcatcattgacgatgcggacgagatcccggcccgtgacggcgtccttttcctcaagctctacgatggctggaccgagcccttcgccttccacatgcgcaagtcgctctacggcttcttctggaagcagccgggcaccctggaggtggtgtcaggctgcacggtggacatgctgcaggcagtgtatgggctggacggcatccgcctgcgccgccgccagtactacaccatgcccaacttcagacagtatgagaaccgcaccggccacatcctggtgcagtggtcgctgggcagccccctgcacttcgccggctggcactgctcctggtgcttcacgcccgagggcatctacttcaagctcgtgtccgcccagaatggcgacttcccacgctggggtgactacgaggacaagcgggacctgaactacatccgcggcctgatccgcaccgggggctggttcgacggcacgcagcaggagtacccgcctgcagaccccagcgagcacatgtatgcgcccaagtacctgctgaagaactacgaccggttccactacctgctggacaacccctaccaggagcccaggagcacggcggcgggcgggtggcgccacaggggtcccgagggaaggccgcccgcccggggcaaactggacgaggcggaagtctagagctgcatgatctgatagggtttgtgacagggcgggggtggcggcggcccctagcgctatctccctgcctcctgccggctccttggttcttgaggggaccaggagtgggtggggagtgggggtgggggtagggtttccctactgaagcccttgtgaatcaagggtcaggcctttgagctcagaaaatatccctcctgttgggagagggcgcaggccgtgacgtctgggtggcccttatgactgccaagactgctgtggccaggaggtgccactggagtgtgcgtggtggtccctgggtagcgggggagggtaggcaggattggggaagagagcctgcaggatctcaccaggcagcctctggggggtggccaggccgggaaaaagcccaccatttggcatccctgggccttgggctccgtgtgggagaccggcctgccaggaggacccagggctctgtaagtagatgcatttgggtccaggaggaagcgtggacacctcgtagggaagagatgaaaaagccacatcctaccaagaggaggtgctgagggatgctttgcagtgtagtcagaagtgctgggccagatggagacagaactccaccccctgccgcaaaggacaggacctggctgccctgggatgctggtgcctgagtctgtctctgtgcacccctcaggctgtcgtgagccaacacaggggcctggagaaccctgaggagctttccttttggttctaaacccggcgttgacgttccttctccctttcacattgctgtcttgtggactgtgcactcagtccttgcaaggccaagagtccagttgtaggtgtggccttgagggggaagtggggaggagaagactgacatgagtcctctgcacggatccgtctctccctccccatcaccccttccttctgacacccagtcccagctgtccactgtcccaggtgcagtcactgttgtgcccttccttggggcaggctggctgggggccagaaaggggccatgaggctgtcttgggcccaaaaagggacaataaggccagttgtatgcttcctgttcctcatagcttgccttggtggggatgtctttgttggagttgattctgagctgctgtgattaggagaccctgaaatacagtggtttaagcaagatggaagcttgtttctaattagtctagattgagatggcccagagctggtagggcagctctgcgtttcttcatacgcaccttccaattctgggtacacagcggctgctccagcgcccaccctcctgtgtgcatccaagcctgggggaagcagaaatagacaagagggcacacccactttttgctaaaggcatgagccagaattggcaggctcacctctgctggcctctcattggctgggactcagtcacatggccacaagcagctgctagggaacctgggaagtgtagtcttcagcggggccgccatgtgcctggcctcaccttgggagttatcttattgatggaggagaagagaatggatatgggggaccagtagcatctctgggagagggggagggagcagcaataactcagtcgtcggatccagctctcattgtcagagtttccggaacagcttgctcctgtttccctcactgtgcagcccagggctgggggcagtgaggagcttgcagctctgtgggaaggggaaacaccccctcccctcggcccctcagacgctacccaatgatgccggtttgcagagttggcctgtggaatggctcatgtttgtgcgtgtgtgtgtgtatatttatgggcatgggtgcatgcttggtgtgtatttgtacatgtctgtattgctgtgtccctgtaaatacatgcttgtgtatggatggaagaggccaggcccaggcctggcctcttcctcgggcctgtggccacacctcctgcagctccccaaaatgactgaggcagaaagcccttggggagcctagaaagcaaagctaaaggggatgcagggtctgtctgtctgtctgtctttcagtctgaggaatgagaatcctgacctgagggctgtgcagctgagagcccactacctccccagcccctctcggccccagccgcatcatcccacctgtcccctcccccccacctccagtggggctttctccagatgtcttatggttgggggtttcctgatgggccaggagaggagggcatcttcttgcgacagcactgtctgggttaagtgcccagtgagggcatggtgtggggagctggcctcagaggagccgctggtgggcaagcgtgaagtgggctgaggggctctgagccactttgctcccatctaggggactgccccccatggaactcctttgaagtcacagcagccttcctttctgtttgctcttggggctgagaggtggctcaaacactcggggtccctatggctctgggtcaatctaggccaggctgcaccccatggacagggagtctcagggctcctgatcatgcccaggccctggcctggggcctccctccttggcagctttcccacccccacgcccctggcatcctcagttgctatgggatgcccctccagggcaccagctcagggctaagcgaaggaagataggagcagctcagagctgccaggctctgccttcctcacagacctggtggggcaggtcctgttcacagcagcaggagtgaaggcctggccatcggtggagagggcagctgtcagagggctgggggccagggcacaggattgaagagtttcacatatcatcacagcatacactgggaatttggtgggggcagaagaacccagggccactccctcaatatgaagggaaaccaagctgaatgtgaccaccggcacactgctgccatgtcccatgtccacctttctccccgggaataactggccctgagacccctagacccaaggaggcctgtccatgccaagcatccgggaagcatggctggccttatccacccatgggtcacgtcggttcccaggggcagcatgggagatctttgggggcaacagggagagtctgggtggggagacgggacttgtccaagcagaaggcaggaccctgggaaatgcataatgtaaggacatcaataatagtattattttttttgtaagggaaaatcaatatgtacattctgaaatcattttctctgtaaatggttggatttcatttcacccttaaagggatgcttaaaggagaagataatattaataataaaaacagctacaaagtctgaa

SEQ ID NO: 12560 - DNA, 569 bp, Homo sapiens
  ENST00000429402
acacctgggctcagcctctagggaggaaactgctgccatagagccttgaaagccaggcagaggggactagacactgtgcctcaaggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggc

SEQ ID NO: 12561 - DNA, 552 bp, Homo sapiens
  ENST00000418314
gtatttggtcgtccagcgggaaacccaaatggaaggaaagaaaaaaaaaaaaaaccatgcatttatagaacctctgccaatggccaggctccatgcagaatgctttgacaccgtggctcagccaggtctcccacaggactgcaaaacagagggtgacatctttcttttagatcggagaagactgaggaccagagaagctaagtaacttgccaaagggcacacagcaaatggagtcttgctcttgtcacccaggttctggagtgcaatggcgtgatcatggctcactgcaacttccgccccctgggttcaagatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgc

SEQ ID NO: 12562 - DNA, 25116 bp, Homo sapiens
  ENST00000611864
ggtatcaacggtttctgtacagcacagattatgacagcgtctttcttaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggtggaatgataatctggtttattttttctgtaaacttaagtttccgttgacttctgtacatctacaatgaatacctcctcatagaagtggtgtctttacataattttttgtgtaggtgacactatggaaaaagaaaaaaaagacttaaaaatatctctcccctgattatttatatgaaaggggatattgttcattgtttaaaaacatttaattgagcacctattgttgataaattttctgggggaagcagtctttttcaagtttcccttttgaaaaaaaaaaagaagagttaagctcaatattttcaggttacattgagtacccacatttaatagaataaattagggaaggcctatagtagttagctcattcgtacagacattttcagtatatgcagaaaatttttggaaattgattttatacattttgtattaaaatccatgtgattgaaattattgtgatttatcatatacctttttggaatttaaatgggtatattataaaggagaaaagtaagaaccatagaaattagttgacttttctagaatcaaagatctatttcctagcaaggccagaatgagagatctgatattctgataaccagacaatgctctttttctcgtatgatttctcctgacagatttatgctttgtgttctatttgctacatgcctgtcagataataagttataccatctggaaataggtggtacaattcctgcataaataatattatcctaaataatgtcctaaatgatgcttttttggtataagcacccaaatagtaagcaaacttgactaaacttttcctaatagggattggagagtgtgtctttacaatgtgtccgttaaagtaattcaggacaccttagtgtgtcctaaagacattggttttcagaatgtcctgagcttgtctcttcctttttgttttttaatgaacagcaaaaactaagggatttattataaagggaaatggaaggtgcttcatatatgtttaagaaactcaagtacgtgttcatatagatgactctgtgtgtgtgtgtgtgtgtgtgtgtgtgtgtgtgtgtgtgtgtgtgtgtgtgtgaaggctagacttttgctggtaagacagaatgaggaaatcttcctgctcttccttttcatactgaaacacaatccttaagatttactggtatgctgtggtgcaaacaacactaggatatttttattttattcgttctctgcaaataaatgagaaactcagataaaaaatggaaactttttatttcatttataaacagctgttgtgtattttctttgtattcagctactaaagtgttagaagaaaaacgaacctttcataagaggctaaatattaatattttgtgaggcacctaaatcttacagtcataggaaaatatgaacactgccactaaattattatctttaccttgatttagaggatacttgccagacacctaaaaatgttctattttctttatttttcttatcttttattaaccggctagttgatagtattgtgtgtatatctcagaagttacaaatggcattattttcttcactgtcaatgataaaaggtacacaattgtatgccaaagacatgtaatatcaagagctaggcagactccctgaaatgagttgtaaccccttacatattcttctgggaatggctttctaaagatcagctattggtgtctatcaatgtcttaaaaatgtttcaagaaacattgctgagggtagcagtgaagttggatgtttgctaggaaattatgaaaacaaatgtgactcagagaggtcatttcacattttatctttatatcctctctttactaaacctgtgtttggataagttggtcaatcatccaaggatcctctatgttttctttacagttgacactgggtcaattttctaaggaaaacaccttgacaaataaagcatcttcattagaggtcaggaggaaaaataactattctctttcaaaagaaaatctgaacaatttttttagcatggcccaatgttctatttcctatatttagaaactttgaataagggtctagtaatcttgtctcagaggcatagaaacaaaagtacagttattaggtttaactatactcaaactatttgctatttttaaacatttttgctgtaagtttatatatatatacatatataatacatatatacatatatataatatatatatacatatatatataattttctttgttaaaaataacaattgaaaaagactggcatgagacatgaatggctgagtcatttaattgccatacaaataaaatgctgacaggtttcaagcaaaaaatacagtatgcaccttaaataatgcctcagaattgtataatttaagctcactaaaaaccttacttagtcttaaaattctccttaggggagccttttcagcagttatggacatcaaagaaaaaagtatcttgtaaaagcacaatgaaatttagaaaatacacattttagtggcaatcacaaatgtcaatataaaagatacataaaatatgttaatgcaagaactttttcatattcattgaaaactataactttgtgctatttataaagtagatattttccaggtatgaaaatataatttggaaaccaacctgtcgtttagatctatttctttcatatagctacactatgagttgtgaacattccatttcttactgggccagtattctctgggaatttttataatgctatcatagaaaaactgttctgtataataattatataaaaaatgaaacaaacattttcaaattgtaatatatgatgtggtatggaaagtacctacatttttagatgctcaaatattggcatatttcatgtcagtatttgccaatttgtcaacaagtttatggcaaagaacatgataccaggattaacattgaaaacactacatccagtgccatctaacaattgaaggaaacagtgtgtaattctcttctttttccttgacaatacatccatcaacacagtaatggcatcatattactgagtaatagagctcacacttaaactttataatatttattatgggatctactgataaaatgatttaccgttttgtacaaattcaactgattttggggggtttcttgtaagatttaatattaattttaggataattttatcctgtttcttttgattcatgatcccaaactttctagatcttgcttctgtcattccacgtcttattatgcctcctcagctttgtgtttcaacaaattttatatgcatgccttttgtcttcatgggagacaaaacagaaggttcatacagacttgattttgacacccagttctgcattaccagcctcccaatatgaggaaatttacttaaccttcttgaaactcagtttctacatctgtgaataggaataattttacctcatatgtttttaaaggtagcaattttaccttgtagctccttgtagagctggaattgagataacataaactaggcacacaataaatatttgtttcctttttatccatgtcacgtatatgtaacaggatatgaccctggaaaacattaccagaggccttcattgtaatcaataacaattataaaatttactgccctttaaaaatgttattcagcctaccttttcatattttgtccagagaatatcatgtggaattatacagacactttcctaaaatcaatatatattcctgtcattctaatttattactctagaaaccttatcaaaaatatcaaaattgcccctagtgctctcatcacaaataataatattcatttctgttttaagaaatcttgatccatttacattgaaaaacaaagaaacataaagtcatttcctagtttctaagatgttgtttagaatctaccttaagctcagaaatgcagtcttcagaatctttttactttttttttttaatgtcaggatccggttctctggcatcttttctatcattggcaaaagttatcaatgcactgacctataaattaccttggcactgatgtttgaaataggtatcttatctgctagtctactttgagtttcattgttgagttttccattactttgaatttctttgttcagattggggttattctttttaggaagaaaaaggccataacaaaattcaatgtgattagttattgccatttattttttgtttgcttttaaactttttttttatttatcccaaacagaggatatatcttttattactttttggcatgctttgaaatgatttcattattgcatatgtgcatgtgtgtatctacatatggttaatctctcaatctgtgtgtatgtatatatacatatgtgtatgtacatatgtgtatatatgtatacatacttgaatattatgtgaatatgtgtgtatatttgtgtatatatatacatatatacatgtatgtatttgtatatgtgttgtgtaagtgtgtctgtgtgtatgagagaaagacagaaggatatgcaccatttgcattattttttagcctttacacctccacttattcttggattttcctgacacactgtcctcctggttgtgttcctcttctgaacttgcttttgctttcatgttctcactcaaatcttttatacatgacatcctttgaaaatcacagcacattagagatctttgtgcatccttttagatactttaaatttattaaaagtgtactagaggaggccatctctctcaaaacagaatttttcttttagagtttcaggtttatggtttttatttgaattctttaacattaaaagatcaaaatatgagttgcatagcattctctttctaagctataaaaatattaagataacaaggttgcactttcccaaagttctagtcccttccacctcattaatctgttcatcacatttactccaagtccagggtagaatttgcttcaataatcccaatattttctgagatgtttaatatcctatttttaacattgaaattgaaatgtatgtttgagaccatttgccagataactggatctgaatatcttttctgaaaaacatggatttgagaccaaagcagtttttgatttgactgttgtttcagctttcatttcactctgtctagacggtctcttagaagatttaccaaaaagttaaattgattatgtgagaaagtgataggtaaattgtatatgaccatagaagtacaattaaattaagaatatagcatgatcaaattttcacattatattggattaaaaagtaccctaagtagccatctccttaaagtaggtgagccaaagacataataataaaatattcaatatttttctataaaatacaaatttccatgaggcacacatacattaaatttaatataaagagaatcattactttatttaagagttgtttaaaggtgcacaacaacagtgagttaccaatattcagaaccttagtctataatttcaatgtactgtaagttactacagctttaaccacaatagctggcataacctaaatcattctgcccaaatacaggtaattatagttttgatgtataaaaattaccaaaataaatgcatatataaagcaatagaggctgagagtgttcataattgaaagctaactattgcaaaaatattttaaatatttaatttatagtgcactcgaagttctggaagagacgtaggatttgtctcttccaccctttccctcactttaccgtttattatgaaggtaccaaaagtatggcacagagatatgtggcagttccacatatctcaatcaacaaagctctaactctattagaaactagacatttaaaaagtactttttttgtaacttcatctgagtcaggtttctcattgaataataatctgtcagttttgtctatagtatgttccaattggaaaatgtttaaggtagtacatgcctcttttctccataaaataccccacatttgtttaactatttgacatagtcctattttttccatctttaataattgataaaattttccctacttttaaacatatgtatgtattttctgccacacttaaactttgttattccacgttgtaacttacttcatcaatgagtgaaagtatagttccaaaaagttagaataattatctcagatcctttatcataattgtccaattatctcagatcctttatcataattgtccatcctttaatgtaatccggttttcaatacaagtaacacttgcattcttacaactgtgcatttttggtcactaaaggaccatgtgacgatatcagtagttgtcaggagttattcactacccttagaaaataaactcggtaatgtaaactatatcccacactttaacaattaatactgttgaatgacattgaaggattgtatctttttttaataaagaagcaatatattaaaaataattaaaactcctaaagtctttttttttgttttagaaatcagtctcaattttcaaaagggcatttgatatctgctaataaaatgaacaaatagtttttctttaaatgaaaatatctataagcttagctgtgtgtagaagtacataataaataagttgtccattttgaataaaaattaaaatcctattaatgcagttgtaacttctcttcttaacatttcttaagctctaaaacaaacataattagacacattttctgttgcatgtggcatctttacccaccataatttggtaatcagtcatatcaaaatcacttacaagaaccaactatttttggaaaaacatttagaaaatttgtcacaaattgtcaagaagattttcaagacatatatatgaattgtctgtaatgtaatggttggggatattttcattaaatccataaaccaatgtatgtatgctgccctctaactttctgctgagttactgtagtcaatggtaaatatagtcaaagtagaaaagacacattcaccctgaatattcccaacaacctatctctcattcaattctgactattgacaaagtactcctttcaattattgtggtaaggaggcctttctgagcatccagatgtgtaaaaataacaacaggggaaatgttacaaacatgaggtaaaaggatgcagaggaaaagttgtacttcatgattttgcctcaagcaagttcttctttcctgtcagcattgcaaattaccatagctcgacttgcttgtattcaagcaaatcaaaacttgactccctgagagggtcaaaagacaattttggtacgtatctagtgtttttacttactagaacaaacaggtcaagtttattcttaatgaagttaaaatttcaaattaaacctgaagctctagtgttttccattttactaagtggataaacacttttctgccatgggatgaactacaatgagatgtttgaattgatttgggcaattgatttgggcaatgatgagtcatgtgtttgctacaaaagtgatacaaaatataagtgtccttcaagttaaagcaatctaaaccgatcatctttgaaaagttaacaacatattttgtaatatttgtttcctagcaaatttttcagttgtccaaaccaaggtaatgtagataaagctacatattttcactcagcgtaccaccaaataactgggtgcccaatagtgttgatctgatgcactactaaaattagttaccataaaaattattttcttttataagaagaaagtgaaatttgtttaattattttgatatcttttatccttatgaatatatatatcaatgttaattttttatgaataattaaatttattataaatgcactaatttttcaacattcttctgattttcatcagtaaattgaataaccattgttgcaatgaaatttacatattgctctcataatatgaaattttacaaggtataatttcacttaacacaaacaatagtcctcataccactttttcattttaactttaatctcattatttatgtgattaagtttgcaattttagccactcatgtgttaggagcaatagagattgacattatgtaggtaggaaaatacatttttagtaacttaagaaacaagttgtacatactatatcaacatttcacattagtgaatttattatcttgctgtataaactttaataaaaacaattatttttatttaaattatttaaggttcctctatttgacttcaaagcaaaataatatctgaattgtacaagcactgtgaatttgtaatagtctaatcacagtctaatcactaaattcaattagtactttactaaatttcttacagtatgctcaggacaaataatttattgaaatgagtatactcaggatggagttattttcatgcaaacttaaaaattacaagacatgtttagaagaattatagctggataacactaaacattcacaagttttaagttagcataaggggatttataagtaatgtgcctacgttcataatcaatttaacagttttcactaacttgacccaataatttagggtgtatttccagaccacaagataaaactaaattttgtccatttttaccagatgattcaaaatttaccatttgattcatttcttaataaaactgcctgtcaatctactagactaaataagaatataaataattcaatattatttatataaacaaaatcaatggaaaatgacaattttatctaatttaatcaatgcctgtgacttagcaaagatattcagttcaatttaacaatctttatgaattaatatttccttaggaattatgtagctaaattatattaataatccatatttattgaagggtaaaggccacagagtgagactaaattatctaggtccagagaaaaggcatctagggcaataaggaaacgaaacaaatataacaaataacttctaatttacagatcacttaatgtaagctcagccaagaacaatgcttactacataaatatgttccaagcaactatgagacactgtgtgaagatttcatgtgcatttcactgtctatttaatagattaaacaaccatataaggtaagaggtattaaaaaagctaaagagcatatgaaaaatagggttttactaacttgtccaaggtcacataactaataaatgaaagagagagcattggatttcaggtttgtgtaattcaaaatctatgccccttatcactattatacattgcctcctaactataataataatttattgaaaacccatttgtctaagatgggattttctggatgatatgactatattaaaataacattaaatagttgaaaaatgaatttaaataattagtttcttcatgtaaaacatttttttctcattttttaaacttgaacatctaaaacacttgcttctgtaattccactgaaccacaacctaatttctgttattccaaaaagaaaataaaaactcatgggctctgggtacactaaaagactccaaaaattataactttgtattaatcatataatagtctttcataacaccagccccaaacataccaaactggtagttagacagtatgtatgcaacattttttgtgtgattaactatgtttctaaatttcagctattatttcggatgttggaaaacatcagtaaaccccaaagttgtgtttattggcctatagcttacatgaactgagtgtttaatatgtatttggtactctcctaatcggtacttccattacctatgaaagtaatgattataacaagtcatcatgcaaaagaatcatcttttcaatatattgaaaatgtgtgtttcagactactgaattcttccctgtaaatctaggatagatctaggaattggcactttcaatgtattttagttaacactgatgcagattgtccattcactccttttagaaacactacattacatccttacaagtctatgaagtattaaaacagaaatgactattattattgctacttcagtgatgaagaatctcaaagtttgagttaagtgatgtatcaaaactctgaccttgttagtgaaatattaagcccagttcatctcaacattattaacctctgctcacacttgtctaaattactagtttttaagtctggctgttcattaacatctctggggaagaatttcacccattcctgagctccatgctcagagttatcataattgttctggagtttccaggcatcagcatacttttaaaattcttcctaagtgatcctaatgtgcagacagatttgacaaccacggagcaactaagactgtaccacagtaaaattccaaaacttcccatttatccagtttgaaagattatagattagaaaacatgatgacaagcgtagattattctgtgttgtttcctgccctttttaggtatttcaatactattattgttgtactgaaaaataaaagttccagtcaatttttatggttttgctgggtttatagagaacactctgcatgccttcctattgaatctgggactctcgtttttggagaactacgtaagtgatctgttttcctgagtcttgacatatgcaccttattaattagagactataaatccactttttaacacataaaatctaatgatgacatctttgtagatattgaaattcaagaatataaacagcattgccttcaacccactgctgtttgtaaactgagctgccttcctctttccacaaaattaactaaacatattcaagaaagaaggagaaaaactatcagttttccacagtggactttttttcataaatccttcaaatgtcagcatgtatgccttgtctcatttagtcatagcccatatgatccaaatctccaatttatttgtttttctttttccaagaactgggtactttaaaaatttgtcaaatttttaaatttcagatagctgaaacagaacaagtcatattgacttgctctaagtgtttaaaaggtttgaggttattgatataggcctcaatatatttccacaaatgaaataatgtatttacatagagatctaaaaagtgtacgaaacttgagatagctatttgagtcaagaaaaacaaggactgtgaatagtgtaaattatgtaaatatacacagataattcacacacacatattcacacatagttccaaggattcccctatatcaattccaactcaaaatttctcagtcatttctggctaaagagaaacatgtccatttaattaaaatcacttttaaaaaatctgatcatctattctttatgagatcaatgaatacattattttaatgctctgtcttatttaaaatatttttctacatagtgttgctagctaaaatgaggcttttttaaataaatggatacacctcaaaataataatttgagatcagtttcatcttggacttatatgattttcagattttatctgcataaaattagattttctggaaaactaatttgtattacttattttctctgtataaaccttgctgaaaatgaaaactaataagcttgaatttatgggttttatgtattttaaaacgtaatgtatagagatttcttataattatttgacagcttcaagataaccagttttttctttaaacattccactgattaatacaaaaagtaacatttttttcatgagatgaaatgaaacttgttcttaggcaaacatcacttaattaaagcaatttatagtgaatacactcaattaactgattatgaacctgcaacaccaaaagatttaccagatttgttcacaattttactgctagctgatatcaaataagaaaaagacaaatcaatgttatatcttcaggaactaataacttttttcatcctgcaagtttgtgaattcaaaaaaactattttcaaataactaagaatttttttattattatactttaagttttagggtacatgtgcacaacttgcaggtttgttacatatgtatacctgtgccatgttggtgtgctgcacccattaactcgtcatttaacattaggtatatctcctaatgctatccctcccccctcccctgaccccacaacaggcccagtgtgtgatgttccccttcctgtgtctatgtgttctcaatgttcagttcccacctatgagaacatgcagtgtttggtttttttgtcgttgcaatagtttgctgagaatgatggtttccagcttcatccatgtccctacaaaggacatgaactcatcattttttatggctgcatagtattccatggtgtatatgtgccacattttcttaatccagtctatcattgttggacatttggattggttccaagtctttgctattgtgaatagtgccgcaataaacatacgtgtgcatgtgtctttatagaagcatgatttataatcctttgggtatatacccagtaatgggatggctgggtcaaatggtatttctaaaagaactaagaatttttaaaaagattttggttatgtaattagagtgcacaatagaataaaacagccaggttttatattttcactggcaaatgataaagagacaactttgattaaatactcataatttttataaaacctccaaagtttcaaagtaggtagatgatgggtaataattaaatagagtgacagtgttatatgccaggttaaaaaaaaaagagacatgcggcttcatccacaagcttagcaaaatatgagaaagtaagaaactgtggccaaatcagataaacataaatgagaataagttgtagaaactgaccttcaagttaataattaaatcagatggtatcattttcctccatctggttattattgtttagatttttaatagtacaaaaataaatgttttatgaattattttggatgcaattacagtaaataaccataatataaaatgtctcataataggaaaataatgcctgacacttttaattacttaacatacctttttatacattttttaatgtcatttatttggcagctatttaaggagtgccctctgtatcctgggccatctctttctatccagagtcctacaagtcaccttgtatcattattaggatatagtataaaaatttgtccacttttaaatggagaaataatacagataagtaaaaaaatgatgtaataatttgagttctgtacatgactcagagacttggacagaattgacaattctaagtttttaagttaaaccaaagctgaaatttctaatcatttagaagctaggaaaagttctgtttcaaattcaattgatcacttcatgaacagtttgttcataattacttcttctctgcctttcagcgtagtcttgttcaattgttcagagtgtccttttttttttttttttttttttttgagacagagtctcactcttttgcccaggccggactgcagtggcactatctccgctcactgcaagttccacctcctggggtcacgccattctcctgcctcagcctcccgagtagctgggagtacaggcgcccgccaccacgcccggctaattttttgtatttttagtagagacggggtttcaccttgttagccaggatgctctcgatctcctgacctcgtgatcctcccgcctcggcctcacaaagtgctgggattacatgcgtgagccaccgcgccgggcccagagtgtccttattcccaagttcgtgattttcataatagtaagagaacaaaaaacaaatcttacaagcaataaattttataaatagtcttctcttaagatgcagaacaccaacatggcacatgtatacatatgtaacaaacctgcacgttatgcacatgtaccctaaaacttaaagtataataaaaataaacaaataaataaatattcaacacctcactctaattggaaaggaaatgtgcctacagaagttaaagcacattctatgagttttaatcttaggtgccaagaaggatccatgacctccacatttgacagagaatagaaagactccacggttttcatcataatccaagggaggtcagtaatagtttatttgcatttctcgagggctctctggggcctcactatcttacataaaagtgagtttaatcataggactttcagacattagcccacagatgggacatatattttgggatggagaacttttaataaatcacattacctaggtggcctctcattctacttctccatatggcagactctgtaggaaaaaaaaatgcttcctataatgtttcttctttaccacagaactgtcagaggaaacagccgagaaaaacttaaaactaagctacaatatttggcaaaaataatggtagttttcagaggagaagcaatttttctggcgtatatgtaggataagagtatcttaccttccttaaataatgttatctttaccagtaaacatgatgtatttgccttaacctagtcaatttcctttacctgaattcccttaagtttaaaatcataatttttcaagataaggttctagtcttaggaatgttgcttaagaacctgaaatagaatgatactattatttcatcctggtattaaaatctctaaaattttctacaaaactaacattctatgtgttctgtggccaatgtgataataaatccttgcataacaacagagaaaaatatcctatacatttgtcttacatttttgcaaaataaagaaaatattttggaattaaactaatttcaaaatccaagaatttctatgaaagaattttttagcagtaaccacagatgaaaagaatatcatttagtatctcttcatagtgtctttataacataatctaatcattggtgttttataatctttcataatttttcatatatttgataaatcctgatgttgggtttatttctgttgaaacaccagtaattgttttatgtcactttgacttttttctatagttttgttttctgcttgtttatctaaattatcatcatagttgtaatctgagaactaggcaaacataggtacttttgactatcactttggggtgatactatttacccaatatgattttttcccattttactcttgaagtatcctgttgcttactcttttgtgtatgcatacatttgaaacatatgacctcccaagcattctactttctcttattttacttattgtgttggctttactgtttatgtatgatttaacataaataattattttgttttctctctcccatcacccaccccatttacacgttacaacaagacttcatcagccctggggtcatgatttgaattatattatctgtgccattaaacaaccttgagcctcaataatatctgttcagattttttcaatggctattgttcattgataattacattctggggacatgccagaatgaaatctcatggtttctcagccacaaagatttgttaagaatcaaattcaaaggtatttgacttggtatttatgattcatggcaaacccaagcataatctttagcagatctttaagcttcctgagcttataagcaaactctgtgtgtgtctgtgtgtatgtgtgtgtgttcctatgtgggtaaatttttcttgatagcatctctgtgctttcatcattatcaaaaagtttcaggaccccaaaatggttaagaaacactgactatgtgctagttacatttcaagaatatatttctacataaaaatgttgtatttattctaaaggcaaaagccatggaacaatgtgtacttttaaaatatttatgaggaattaaaaattcaattattataatttttccattttaaaattttaggatgtgattttgtaatagcctccaaaaaacatttaaagcacccaagtaattaaactagtaaaagttccttataaaccagaaagcaaaactattttccaaatgggcaataaaaatattacttttgcatgtaaatagttgtttaagtgaatttattgtttatattaattaaattcttttggacaatttgccacttaaaaagatcagtgtttgaactctaggaaatacttgtttatgtaattttttttgcaagtaggtaagaaaagtatatttcattatcaaatagctaccctgcaatactaacataaacagctatttacccatttagacttaactattcagtcaattacacaacagtcttaccatgttatttaatgagtggaacaaaaataaaggtctttataacagataaaatatttcatttatataatgaaataaaatatcttgggattaataaaaataatgatttttttcatcctatgtaaaatgtagttgatagcactgatatattaataatgttatgggtgaagtttacagttcattacaagttgaatgtacttaaacaatctacatccttcactccttcattcaatcatttaattcagccattccttatttgacaaatgtgatttgtcaaatcacattactaaatgtattatacatttagtaataaccatacatatcatgttgaattgttgtgaggataaaaaagtaaacaatgttcaattattgttaatattttattttataattaattataaaattttatataattatataattatataattaattatataattttacttcattggatgttgtaaattgctctggtttagcctttagacatttgaatcaaaatggtcaaattagtctctaaattcagacattgactttgttctgcagatctcaaaacgaaagatatgttgggatatttagaccagaatgcatgtgaaaatactacatgaatgaatgtatttgacactgatcttgagatgacaatctacagtcctacaataattattctaactccatgttctctttcgtgcacactagctagagcacatctcacccactgacattggaatctatcctttcgtaagttatttttaacgtcttaggatgacttttataaattgaagatttaagagtttctaaggggactgtaggtatattctactgttgtgtttaccacatgttccattcagatacacaaaagaaatgaataaaactggacatagcacacagtctcactgctttgatgggcaatgatttttgacaatgggtaattaactcttacatcattaagttccatcgtcacagaataaccttagaatcctaataaaatcccacggcttcaaattgtatttaatagctgccaatccaagcctcctgactatgctaatctattatttagaataaatgaaaagtgtgtatcaatttgcctattataatacaaagtgggaactctcatgccaacaaggttaggccagaaaaattcaaataaattggagatgtgttttgatacattttcttccgttgctcttattgtatctgacatggaaatttccttagggtgaagtttatatagtgacaagcatatacaatattcttgaggtattaggccacagtcagaaaaagagaatataggaggaattatgtggtagaggatgataaaagattagaagttgaaactataccatatataattttatatatatacataattatcttgattataacctaaattgtaaaatctcaatattattagtaccatccccagacacattccctttgtttcttaaatttttactctccaaaaatgggaatcacagaaacagaagatgcttaaatgttcatgttaggcatttttttctgagctcataaaagattatttgatcatttaatgtgtttttctctccaataagactgtaaaaagttcagtgtttcgaggctgctaaacaatgcccatagagttgacagtctcaagaatgactggaaaatgatggagttggatgctataggtcatactttataaatctgactgaaggagaattagaatactaatgagagtcaacaacaattttcttacctgctcccaatttgtaattcttgccctggtggcacatatattacaaggagaatattgttttcaaatttatagtcagaaagtcatttaggtgactgactttgttttttaaatagtaagttgactgtcttgtttaaaaatgcatagtgccctggaaagttatgtgaatacaatgatttattttaagtaaagggtagttttataaaataaagtgccaaacatcatataaataaatatttacaggctcagtatcaatcaaatcagtggtaagagtgaattttttcaatgtatgactttcatatcaaatttttttttggtgattcagcttaataggagtttatggtatgggcccattcacgttatatccaaataaacaaaaattatctagagttgttcatgccatcatttccttcagcacagtcttcaaagtagttttctcattacccactttgaaagatatttccaaggagaggataatgcaacccattctatatgtgaataatgggtgggacacaggccaataatcatgatccaaattagtctgaaaatcaaaggagtaaggggagaaaaaaagaatgaaggattaattgatttgctgagagcatgtcacatgctaattgttgttttacatttttcatctatgtctctcatgtgattcagaccacaaatctgtgtgataagtattgttatccttattctaccaatgacgacacagtagtgaagtcataattcagacttgaaattctgtcttctctcaattttcatcccaaaattagatatcctcgatgccagttcggattctcttattcaatgagaaaatcacttccttttcggcccttgtcatctttgtctgtataacaaggggataagacaaagacgtttgatgaaaatttcttcaagttgtatcatgtttttattcttagtgggtagtcctttgtaagtctgcatacggctggctggtgacacaatgtgggcaccatagaccgaaaaataaaattactgaaaaggcgaagtatactttccaaaaattagactctaatcaatgtagtccgtgcaacaattttctttaataccgaattgcattttatatagctatttgcacagatcttcacaataaaaccataagaaaaggagaataggatattatcttcacagttctacagaggagtaaaaaaactgaccttgatctaaataagtttagaggtggattttaatcctttaataagcaaaagacatataataaaattgataaatgacaatatcaatactttatctaaaagtaatttcataaagaaacaaagccaaaattgattcagttaacataaaaaagagttaacccagaagaaaacaatgaatattgatctcgatttcagcaagcagaaaataaaaaaaaaaaaaaagcagaaaaaagtgagaaattgttaaggtgagtgaaagatgagcggcggttgctctgagaaactacaacacaacttatttattcaagtggctgggtcagatttaaagatgtgatttcaataacttttttgaatagagtgttgtacctttgtctaaagtagtaaaattcatttgaattaaagctgaatatgggttttcctcctcaaatccaattcaattccaaggtttgaaattgcaggggctcctgagaagaaatggcaaaaataaaaaagagaaagagagagaaaggggaagagaaaaggaaaaaagaaaaatctataacttgaagccctgtaaagcaaagatttaccaaactttagattttataccccctcttttttcagcatatccaaataaatttacatgatcttatgagtgtaaatcttctagtcttcatgagatttttccagcttttctgccttttagattgacatttctagttgcttaaggtttcttcttcaaagcaatgggtataaaacatgtgattattattaaacagttatggaaaataccatctttattccaccactttatcaggtagaacttgaaggtaaaataaagtttggatgctgagtctacatgtattgtattgtattgtattgtattgtattgtattgtattgtattgtattgtattgtattgtatagtggttaccagagatttaataacatagcagaagtaactgaatcgcctcctctgccctatgcacttgtattttttttatttcaaaaatgccaggaagataagtgtatgcaaaaatataaagtttgtaaaattttatacaacttaatctatttgatcattagttaagtaagcttaactaaattaaaaatgtattttattgctactttttttaactctctaaagaatacatttatgtttttgaaggagctttaatttagtaacagttaatctttttattaattttagtaaaaataatcatacccttttaataataaaaattaaactttaagtctttaaaattgctagttgtaagtgaatttgtcaaagattaattcatagttgccaacacttactgaacaggtagataaaattaactttgtttatttaacaaataacttggtgctttctagttagtttaaaaatatcaataattgtttcctcacatgtatttatgtccttccttcacagcatatagtcaaccatagagactcaatgtaaagtattatgataatttatatgtctgagaaaataagaagattgattcattgaaaagttaaatgaatttgagatacaggtatttctgactgcctagttacactgtatgaaatactttaaaaactggccaggcgtggtggctcatgcctgtaatcccggtactttgagaggccaagaactcctgaaatcaggagctcaagaccagcctgaccaacaaggtgaaactccatctctactaaaaatacaaaacattatctgagtgtggtagagcacgcctgtggtcctagctactcaggcggccgaggcaggataatcacttgaatctgggagtcggaggttttggtaagcagagattatgccactgcactccagcctggacaacagagcaagactctgtctcaaaacaaaaacaagcaaacaaacacacacacacacacacacacacacacacaaaaacacttagaaaaactgtaaacaattcagtcttgtatttggaagaatggtgacttgtaaattttgctgtacattaatgacaagtctctcactcaaataaagataacctaagtaaaataatttatgtcagatgaaaacattccaaattttcttggagaaaaagcaacaaaagccaataaataaaggtggttcccattacctatttaattatttaatatcttaaactattattaaatgcatgcaccacctgcactaccctgaccgattaaccccttagctgaaggagttcagtttgtatttttaccatatgatctgtctagattcactcttttcaggattgatagattttttttttcttttttcttttttttttttttttgctttcttattcaactctacagtaaaagaaaatctgtggttttatttgacataacagagctatcttcagccatagctagaaggaggatagtaggataaaggtcaatttttgtcttccttcacagctaacagatatatgtagcatgcttaataataactctcaaagtctgttgctcaacctcccaaaccattaatttccttctagccactgctagagttcatgcatgtcatgaaaggaaggctagagggacaatttctgtatgcatatctctggcccatgcccttcaatgagacccaaatataattaatttctgggatttttgcaataaataatatgagatgacctcattatagaatgaggggcaagatccttggccttggtctttcacaaataatatgactttatttacagatgaagaaaataaaataaaaattaaacataaactttcctcaacttcctgcttttagcccaggtagcatgttattactatttcttttataaacaactgagttctgactaacagtctttaagaggagctgctatgaggaaatatagataataacaaaataataacatatttttaaagctttgccagcagcaaagggctcgcatctacatactctcattttatgtgtccaaccaatggttccacatagccatgaaatcagctgttacaataggaagaccaccactgaacagttttgtaactcatttcagaattgactttggtatgtgcttattggtgtatttctgtgcttgtgtcaattcaacaaagcttcccaagcaaggttacttcaaacattacttgggccacggtaaaagaaaaataaaattctgttgattcagagtcaccttcaatctcatgtcataaattatgtttctctagtctttgatattgtttcacatgtgcatgattagattggttgaggatagactttgggctcatgatttattgactaattatgtggttttcccactgtagcttgggttaaatcttacaagacaggctgaaaactgaaattgttatgacatttttgttttctctacaccataccaagtaatgctgtttgattgaatcaaatattttctaaagactaaatgtaatccaaaaaatgatctgtaaatgttcccaacaggtgtcccaaaaccatattttagtaagtttttcaattggtccaacagttctataaattttaccttgaggtaactaaaatggaaacataatgaatatattatctctattgtctaaggacaaacaaaacaccgaagttattgagaatcagattcccatgttagcataaatgagtcacctagttttttcaacaaaaccaagtaataaataaatcaacactttcagttttctgccagtgtcacagatggcagccaattggtttgattaaaaatctgatgcttgcatgtttgcatagtaaaagacagggttttcaggaaaaaatcattatacttctcactgtgttccacacaatgttgaaggttatgtccaaatttgaaaaacaaatccaattaaactagctaccatacaaatatatcttttgttattgaaagagtgatttcagtcgtgatttttcattaatctagttttgtaaaaatcagacttcctgtaaaccaattgaaaacctctacattttactatatgtattcatggacttaatttcatcaaaaataccaatattctctgtgccctaacaagtgtaattgcactaaccttgtagttgatatttactgattgaaatgtatatacacaaaaattatgtaaaactgattatctagaggtttcttcattagctagcacaaatagttattgtaaacctttgtcctgtatttttttaaagtctgcaacatggtgaaccagtatgcttgatggctttaatacctgtgtctgcaatttattattcatttgaagcaacaaattcagaattgtttgaaattatgaaggctaaacagcataaatacattgtggtttcttttataaat

SEQ ID NO: 12563 - DNA, 3194 bp, Homo sapiens
  ENST00000620241
agctgaacgaattgttttctctgtctctgggtatcaacggtttctgtacagcacagattatgacagcgtctttcttaagattctgtggacctgactgacactagaaaagccgcagtagcatgtgacatggaagtttatattatcagggtgtgctcacctggttgcaaatttgagaccaaagttttactttaacacttggagctggtaaaggatgttttattcattgtgtttctgacagatggaacaagttaaggttaccttctcaatatgaggactaaagcttttagccaatatttgtggagaagacacatttaagattttcttttgcccatacatgcaatgttatggaggctgtgaccacattttaggcaagaaactgaaagaacatcaagcacctatctggatgtctccaaagcctcatctggataaaatatccaatctatttttcaatcagcctttttttttcctttttcaacctcagacaattgcttttggggtcctagagtcccttgaaagttatgatggaaataggagacctaaagttcaggtgactgaagggctgaagcaggaaggaaaaacgtctgggaggacaggtagacagaggaaagaggtctgaagaggcacatatcaaaagattcaagaaagctgaagggaagattgaaggtagtaaaaggatgaaggaggagcagaagcaatgggaaggaagagatctcagaggactcacttcgggaaaatcttcagtttcccaaagagatcctgaagtctcaaattatccttaacaaaaccatgaccacaagaaaggaagtggagtatacgatcagtgagagtttaagaagggggtttccgttgactaaaaagttaccgtgggagaaataggatcaaatagaacagagttgcctcacaaagaaccaaggaaaatatttcagctcagggattcaagaagtaaattcccactcaaagacagaaacaggaagtaagatttacaattcagccagtaccttcctaacagagaagcatgtgactataccaacttcttacaaaaagaaacaggactaactcagcctctgtatagtgtactcaggctctctcagccctcactgtgcttcaacagacttatcatttggagcactggctcaggagtcgaaatcaccaatggctcatccatcaatcaaccagaagtgaagacgaaagcttcaaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggtggaatgataatctggtttattttttctgtaaacttaagtttccgttgacttctgtacatctacaatgaatacctcctcatagaagtggtgtctttacataattttttgtgtaggtgacactatgg

SEQ ID NO: 12564 - DNA, 2582 bp, Homo sapiens
  ENST00000621808
cacaggaacaccagattgccatccctggggaacagaatgcaacccgggatctagagagctgtcacattccaagaaatatttaaattgtgctgattttcttctggagaactgagcccagggaatgaaactctccatcaagtcatggctttgcgggcaatagatcagaggatattgccagttttctaatggattattgttatcgggcaggttttctctgaagcttctcagctgctgttacattctacttggatgggaactggagatcagccagatcacttgtatgcacaaagctgctgtggatctgtctttcaaacaagagctgcagaaaacgctatagcaaggttgaagctttatccactctgactcacccagaaagcacagccctgattctgcgtgagaaaggctatctctacagaaactaaaacggtatcaacggtttctgtacagcacagattatgacagcgtctttcttaagcagatggaatcttggaacgtctcatgcttgggaaggacatggtcagatttgttgtaagaaagactgtgcagaggagtgtggcaaagggatccagaagatgcaaggtattatttagaaaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggtggaatgataatctggtttattttttctgtaaacttaagtttccgttgacttctgtacatctacaatgaatacctcctcatagaagtggtgtctttacataattttttgtgtaggtga

SEQ ID NO: 12565 - DNA, 1937 bp, Homo sapiens
  ENST00000552808
actcatgcttccaggctgcacagagcactgttggatctagctgaacgaattgttttctctgtctctgggtatcaacggtttctgtacagcacagattatgacagcgtctttcttaagatggaatcttggaacgtctcatgcttgggaaggacatggtcagatttgttgtaagaaagactgtgcagaggagtgtggcaaagggatccagaagatgcaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaa

SEQ ID NO: 12566 - DNA, 1423 bp, Homo sapiens
  ENST00000547225
gcccaaggatcactcatgcttccaggctgcacagagcactgttggatctagctgaacgaattgttttctctgtctctgggtatcaacggtttctgtacagcacagattatgacagcgtctttcttaagagacaagttctcactacgttgcccaggctggtgtcaagctccgggcctcaagcgatcctcccacctcagcctcccaaagcgctgaaattacagacgaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaac

SEQ ID NO: 12567 - DNA, 550 bp, Homo sapiens
  ENST00000552435
agtgccattatgatggatgtttacatctcttcattgagagccaattatctcgcttttgtgtgaggcccaaggatcactcatgcttccaggctgcacagagcactgttggatctagctgaacgaattgttttctctgtctctgggtatcaacggtttctgtacagcacagattatgacagcgtctttcttaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagccacatgggctattattcatcatacaaagggacggagaataagctgaaggatgatgatttt

SEQ ID NO: 12568 - DNA, 588 bp, Homo sapiens
  ENST00000602941
aaattctcactcccggttgtggtctccatccggaaatggccgtctcgccgccaggcctgaaggtcaggacctgccagctgtaaaatgggataatgttcaccccaccaccctgctgtgagctcagatatgtgatactttagactgtaaagcactataacaatgaactggagatcagccagatcacttgtatgcacaaagctgctgtggatctgtctttcaaacaagagctgcagaaaacgctatagcaaggttgaagctttatccactctgactcacccagaaagcacagccctgattctgcgtgagaaaggctatctctacagaaactaaaacggtatcaacggtttctgtacagcacagattatgacagcgtctttcttaagattctgtggacctgactgacactagaaaagccgtatgttctttttgttggtggtttgtaaacagtaggtaaaattcagttttattcattgtgtttctgacagatggaacaagttaaggttaccttctcaatatgaggactaaagcttttagccaatatttgtggagaagacacatttaagattttcttttgcccatacatgcaat

SEQ ID NO: 12569 - DNA, 508 bp, Homo sapiens
  ENST00000550365
atagaacagctgaggtagcgttcagtttcagcacagtgccattatgatggatgtttacatctcttcattgagagccaattatctcgcttttgtgtgaggcccaaggatcactcatgcttccaggctgcacagagcactgttggatctagctgaacgaattgttttctctgtctctgggtatcaacggtttctgtacagcacagattatgacagcgtctttcttaagatggaatcttggaacgtctcatgcttgggaaggacatggtcagatttgttgtaagaaagactgtgcagaggagtgtggcaaagggatccagaagatgcaagattctgtggacctgactgacactagaaaagccgtatgttctttttgttggtggtttgtaaacagtaggtaaaattcaggcagtagcatgtgacatggaagtttatattatcagggtgtgctcacctggttgcaaatttgagaccaaagttttactttaacacttggagctggtaaaggatg

SEQ ID NO: 12570 - DNA, 558 bp, Homo sapiens
  ENST00000551921
atcttcactgctctatgcacacaggaacaccagattgccatccctggggaacagaatgcaacccgggatctagagagctgtcacattccaagaaatatttaaattgtgctgattttcttctggagaactgagcccagggaatgaaactctccatcaagtcatggctttgcgggcaatagatcagaggatattgccagttttctaatggattattgttatcgggcaggttttctctgaagcttctcagctgctgttacattctacttggatgggtcctatttctttcctccttttcctcgaataagcattcgtatgcagatgacgggggccttcaaaagaactggagatcagccagatcacttgtatgcacaaagctgctgtggatctgtctttcaaacaagagctgcagaaaacgctatagcaaggttgaagctttatccactctgactcacccagaaagcacagccctgattctgcgtgagaaaggctatctctacagaaactaaaacggtatcaacggtttctgtacagcacagattatgacagcgtctttcttaa

SEQ ID NO: 12571 - DNA, 502 bp, Homo sapiens
  ENST00000551751
gtgtgaggcccaaggatcactcatgcttccaggctgcacagagcactgttggatctagctgaacgaattgttttctctgtctctgaaaacagaagcagttatgacttacatcaactctgaaaaataagaatgcatccttggaatcagaaaatacaaaccctgaaagtgaagtacaagagcttcattagtaacataatgaatgaattataacaataaatgaaaaacaaactaatatcaatgatgatgacaaaacttgctacttttcctaatagagggaaaggatagtttagagatagttgcaaagcagattaagacatgaagagtagaacatctgccaaaaaggcaagccaaagtttaaaagaacaacaaaaacaaacaaataattatttgttccttaaaaatctgctttggtgcccttgataacaaaatgtgtgatatatgtttgatagcacaggttggtcagagaaactttagtaaggtatgagaaaagaacatacacagc

SEQ ID NO: 12572 - DNA, 2159 bp, Homo sapiens
  ENST00000548651
agggtatcaacggtttctgtacagcacagattatgacagcgtctttcttaagcagatggaatcttggaacgtctcatgcttgggaaggacatggtcagatttgttgtaagaaagactgtgcagaggagtgtggcaaagggatccagaagatgcaaggtattatttagaaaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggtggaatgataatctggtttattttttctgtaaacttaagtttccgttgacttctgtacatctacaatgaatacctcctcatagaagtggtgtctttacataattttttgtgtaggtga

SEQ ID NO: 12573 - DNA, 25116 bp, Homo sapiens; identical to SEQ ID NO: 12562
  ENST00000638103

SEQ ID NO: 12574 - DNA, 3194 bp, Homo sapiens; identical to SEQ ID NO: 12563
  ENST00000637661

SEQ ID NO: 12575 - DNA, 2582 bp, Homo sapiens; identical to SEQ ID NO: 12564
  ENST00000636626

SEQ ID NO: 12576 - DNA, 2159 bp, Homo sapiens; identical to SEQ ID NO: 12572
  ENST00000637362

SEQ ID NO: 12577 - DNA, 1937 bp, Homo sapiens; identical to SEQ ID NO: 12565
  ENST00000636211

SEQ ID NO: 12578 - DNA, 1423 bp, Homo sapiens; identical to SEQ ID NO: 12566
  ENST00000636470

SEQ ID NO: 12579 - DNA, 550 bp, Homo sapiens; identical to SEQ ID NO: 12567
  ENST00000636416

SEQ ID NO: 12580 - DNA, 588 bp, Homo sapiens; identical to SEQ ID NO: 12568
  ENST00000637408

SEQ ID NO: 12581 - DNA, 508 bp, Homo sapiens; identical to SEQ ID NO: 12569
  ENST00000637621

SEQ ID NO: 12582 - DNA, 558 bp, Homo sapiens; identical to SEQ ID NO: 12570
  ENST00000637470

SEQ ID NO: 12583 - DNA, 502 bp, Homo sapiens; identical to SEQ ID NO: 12571
  ENST00000635762

SEQ ID NO: 12584 - DNA, 4486 bp, Homo sapiens
  ENST00000301618
gcggggccggacgccggacaccagagcgcgggcggcggagccagcgggcgagagagcgcgcggcgggcgcgggttgccctcgtcgagagccatgggcgcggcgcggcgcggggctgaggatcggcgcggcccggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtg

SEQ ID NO: 12585 - DNA, 4492 bp, Homo sapiens
  ENST00000569840
gcggggccggacgccggacaccagagcgcgggcggcggagccagcgggcgagagagcgcgcggcgggcgcgggttgccctcgtcgagagccatgggcgcggcgcggcgcggggctgaggatcggcgcggcccggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaagctccaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtg

SEQ ID NO: 12586 - DNA, 872 bp, Homo sapiens
  ENST00000565675
gcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggtgaggggacgtggggaggaggcacacggagcaggggagcggtggcacctgccactccatccggggtgctgtccgtcatctccttttgtgaatctggagaagatttggaccacactgtggtacagcccagagtgcatttctaccacccaaatttaacaaccgttaacatttggtcacatttgtggcctgttttcctctttaaataaaacgtcacagatgaaaactaaaa

SEQ ID NO: 12587 - DNA, 1661 bp, Homo sapiens
  ENST00000374998
cgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagaggcaaaggagactgaggagtagccaagagcaagccagatgtggagtcatgggtgcctgtgagaagatgcttctagaaggagatgtggccagcaacacattgctcattgaaaagccaagtaagaaggagactgaaaaatgtccaaagaatttggtcacatgaggctgggtggggcggctcactcctgtaatcccagcactttgggaggtcacggcgggaggattgcttgattccaggagttggagaccagcctgggcaagatagtgagacctggtctttaccaaaaacaaaaaaattagccaagtgcgcctgtggtcccagctactcaggcgactgaggaaggaggatcacttgagcctgggaagtcgaggctacagtcagccgtgatcatgctactgcactctagcttgggtgacaaagcaagactgtctc

SEQ ID NO: 12588 - DNA, 4053 bp, Homo sapiens
  ENST00000428789
gccagcatcttgtagttgagctctctttatcctatagtgggggggccctcctgggtctggagctcagcccccatcctttcattctcccttgcttccttcactcatgcactcattcgtaaaacatttgtgcagccggtacgtggtggagcgtcagggcacgatggcccttcctgccctcctgacccgcctccttcctctccgcaggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtgaggtg

SEQ ID NO: 12589 - DNA, 2923 bp, Homo sapiens
  ENST00000565043
cagcccccatcctttcattctcccttgcttccttcactcatgcactcattcgtaaaacatttgtgcagccggtacgtggtggagcgtcagggcacgatggcccttcctgccctcctgacccgcctccttcctctccgcaggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcgggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgag

SEQ ID NO: 12590 - DNA, 629 bp, Homo sapiens
  ENST00000563627
cgggttctgcatgcattctgagctcccgggcgtcctcctctggtggagtggggatgggaacgtggaagggccgtctctgcggaggacggtacatcccacctgactcaggggctcggcatagacttaactgaatgaataagtgaccggatgcctcgtcatcccctgcaggggagaaaccgaggctgtggagttggaataagcaggggcttctggcgggaggagctggtttgtacggatgctggcagggggggttgtgggcagaggaatttaaattggcagctgtggctgctgggacagggggctttgaacccttctccagggaggtggactgagcagatgtggggattctagaggaagccatggggtgtggtcatgtccttccatgtcctcctgtccatacccctggagctgggggcctggggggtccagcaggaggagatgacccagcagctccagccggatgggatgccagatggcagaggggcaccacccctcctctggccaagctgcgtcttccaggtcaccagaggcaaccttgtcccagatgaaaacctgtgtgtaaataacccggcagtaacttaggggtaccgccaggccggggaagctgcccgctcaccatgcccctgccc

SEQ ID NO: 12591 - DNA, 904 bp, Homo sapiens
  ENST00000563153
cctgacagccatggaaaaccagggcccggcaccccttctgtgtctctgcacctccctgggtttgcctgtggacatctctgtgtccagagcaaggccattcaaggtgatgccaacactggcttccgctgcacccctccctgctgtcattcccgcaggccagcagttcccaggcaggatcagcacctgtcactctgtcgagactgattagggcgcacacctgtaattagacctaatgggggtaatttccaggccaggcaggctggctcctccggcaggagattcgtggcaggcggaacgtcgtcgtcgtcgttggccgtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaa

SEQ ID NO: 12592 - DNA, 2212 bp, Homo sapiens
  ENST00000568598
tcggctccctgggcatggcacaggatgtgagagcccaccagacctccacccccaatgccgagcatggcagggcccccgacggctgggccttctcccgccccatgtgtctgcccatccctcccacaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtgaggtgcagaagaggaa

SEQ ID NO: 12593 - DNA, 4941 bp, Homo sapiens
  ENST00000434178
gtcgccgcgaagccggtcgcgcgcagctcgtcccggccctggcccgccgcaaacgaggatccgctgcgctcggggaacgcgacagcggcgctcgtggccccggtaactgcctcccggcccctgccccagcccgccagtgccgccgtcaggggtggggagcagcactggggtcccggacacgcccggcgtgggctcccgctacccatgtgtgcgtgtgtgtgtgtgcacggtgtgtgtgcgcgcgtgtccgagtgtgcgcgcgtgtgcgcgcgcgcgcgccctccctgctccttcgcaccagcccccaaaccaacttgtccccatcaactccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 12594 - DNA, 716 bp, Homo sapiens
  ENST00000496306
cattacagggaggcgccatcgccatcctcacggccgcagagaggccgggccacttcgccggcatggtactcatttcgcctctggttcttgccaatcctgaatctgcaacaactttcaaggactattcgaggattttgaaacacttgatggaaaaggcatcaagaatgttaaagttttggattccacgtcctttttgggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaa

SEQ ID NO: 12595 - DNA, 3999 bp, Homo sapiens
  ENST00000476682
cattttctaaagcaaatacttctcaggaagtggctctcctctttttttttttttcctacgaagctcttttcttaaaagcttactttaactgcaaaaagttccactgttcatggaggaagaaaatcaggcttgctgggtgagacgacagaatagggcttgctgtaattctctcctggaggcaggctctctctctggctctctgttcccccttccccaacctctgtgaaaccacttcaaggatggctcaagctgcgctgatccttgaggcgccaacagcctaagctgtcagcatcttctccagagcctggaagtagaggccttgtcactttttggtataaaagttttgggttaagaggtgccagcagcagaaacatatgttcaaggatgaaggtaagtctgtcttcacaaatgactgatcctgaagatggactggcacctccaggcccaggtccctgcagaatcaggtgatgggtccccaaaacacaaatggtggcacaatgagaaatctggtggtgggcttggacgaaatggtgtggatgctgggtggtctcttgctttcacctctgtggcaggcactgctgaggtgctgggtccctgggccttttcttggctctgagccatctggtcagggaatgggtaggaagctggcttacataaaacagtcatgtccctgagaaggctgtgtgggccccagcaggcaggtgggttgacctgggagcagcgcctgcaaggctggcacttgcacaccatcccgttacacagagccttcctgcggttcctgagtgtggtggggatcctcccgccacagctggcagccccatgtctcctctggctgcacacaggatcactagggaactttaaaaaggcactgatgccagggctccacttcggccaatacaatcagtctctcagggcagcactgggaggaggtgtttgtggtgtttcatggacacacacactgccagcatcagggagtagtgacagggtactgagaacagcagaatatctagaagtgagttcttcataactgtggaacacagaagtcttccctcacagtgtggcccttgcccactgctgctggaggagagcgctaaggccctggaacactcgtccttacacagccagagtctagtgaaggccacagagccacagcccactgcctttatgcactgatccactccattttctcatttttagattgttttaacctttgaaagcacagatcccaatgcagacgagctcccaattcttggagttcacagacatttgatccgtgtttgaaaataccccagtccttgtgcagagttcccagaattccaagttttcctttcccaggctcgttcttggagctggcccatgatactagctggactcttgaacattcctgacccatcacggccacccttcgaggcttccgattatgcagacacaccatgcccctgcacagtgctcaaagtcaggctgccgcatgcttctatactagacagtcaaagtcggagcccagggctcagcaaagcacctggcacagtggcggctgcagaatgagatctgcttgcctggatgccaaggctggagggcagtaagcttcggtatcctcagaggcagggggctgccacctttgcactaagaaggaattactgatttctaccatttgagaaaaggagtgttgaccacatggaactccgaataggttcatgcacatggaacaaagccctttaggagaaaagcccgttttttgctgtctgcctgatactggatggttgagaaacaatcgtggtgggcagtcacgccacacttgtgcgggcctaggacacaggaaggtttagccctggcctacagggagggtgggcaagcacagcaatcttgtcccccaaaagaacatcagtggccgctggtgccaagacccacgggaaggttagagctctgggttacatttgtggagagagacacagacagcggcagagacagagacgtagtaatccaggctgtgtggcataagaagataaagcggccccccagcccggggcccctcccatggacctcatggtaccgagcctccattttctcatctgttcagtgaggatgaagcctcatctcccagggtttttgcaaagacagggagactggccgggcgccgtggcttacgcctataatcccagcaccttgggaggccgaggcaggcggatcacaaggtcaggagtttgagaccagcctaaccaacatggtgaaaccccgtctctactaaaaatacaaaaattaggcaggcgtggtggcacgcgcctgtaatcccagctactcaggaggctgaggcaggagaatcacttgaacccaggaggcagaggttgcagtgagccgagattgcgccactgcactccagcctgggtgacagagcaagactctcaaaaaaaaaaaaaaaaagatagggaaactgtgcccaatgcaccagaaggtggttcctcggtgcctgtgagtgcccttgccctctgccaagggtactgagctacgtgccctgtgcccttgatgtacactgagaattcactgcttgccaccttccgtccaattctaatttcagcatttcacagctcacttttgaaatagcatctttcatccccaaatgtctgtgcacattgcagaaatgaaaacagcccctctctgaaggcagaagtgtgagatccgggttctctgttttcctgggaaaacaagagatccagaaggagagatgggggagggggtgggaaggtttgggcctcaatcaggctcaagttcaatgagcatgtgttaagctcctgctgtgttccctgggcttttgcacacagggtgttattcaccttccccgtggtcctctgggggagggtcaaggtcccactggcagctgaggaaacggaggctcagcgatgtggaaatcccagcccatgttcacgaggcagcagagctaggaatcaaacccagcaatccttccctctgccacacagcctcctcatcgagctggtgctatttctacttccacccgagagaaatggacgcacactttctctgtgtggctcctgtgggcccttccgcactgccctgcttcgtgctcagttgatctgtgtgattctgcacctgccgtgtattttcagtaccccagagaaatggccagagctcatcccaggcaactcttgccagtgatgcaaaattacaacccatgagcgatcatggggagggtatagagcgggcaaaattcagacgtgacttcccaccttgggcgcagcggctgcctggccagctcccccaaggtggagcagagccaggctgaatagaggctgagtcagaagggagagtccttgggcatgcaggcttaaggacgcaggcttgggagacgaacctggctgatgttcagtttgggcatcactctccttaatgtactgtaaactgtcactgcggaagagccgggtgtggatgccacttgtgctcacagcccttgttttccctccccggctaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaa

SEQ ID NO: 12596 - DNA, 549 bp, Homo sapiens
  ENST00000487473
ccagttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgc

SEQ ID NO: 12597 - DNA, 1414 bp, Homo sapiens
  ENST00000398101
ggatcctgacttcagctgtttttagttgcttatcacccaggctttctaaaagtttcacttcttgttaaaaaatatagtatctcacatcctagagtaatgaacgtccatttttttaaagcaatttgcttttcctcatgcaatcttctttgttttttaaagtgatacttaacaataatttcagcagaagtgaaacttgggttgccaggtgtctgtacttttattaggtttgactgaccctgagctccaaacaatggaactagcactgtttgggaacttctgtaatctcacagaggacaacagatctaactgaatgttttcaagggaaaataaaaaggtctgttccatgttaaacctgggagcttttagcgtgaaggaactgagccgaaagatggtttaacgcttgcactctaagagagccaggattctaactgaaggtgcagaccagctgccccatctctttgcagagctgaacaggagaaaatccttgtaagtgggagagatgcagactagattcagaaggatcttcccctggaaggatgcgagcaccaagagaatgccagaatttatacatttttctcctctgaaaccatacaaagggagggaatgggagaaggcggggagcgagcacgtgctggaaacccaccttttgccagttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgc

SEQ ID NO: 12598 - DNA, 653 bp, Homo sapiens
  ENST00000484451
ccagttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagaga

SEQ ID NO: 12599 - DNA, 446 bp, Homo sapiens
  ENST00000465597
ggtagtttcagaggagttctggaagcatcagaaatcccatgactgggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccc

SEQ ID NO: 12600 - DNA, 1059 bp, Homo sapiens
  ENST00000479967
gtcgccgcgaagccggtcgcgcgcagctcgtcccggccctggcccgccgcaaacgaggatccgctgcgctcggggaacgcgacagcggcgctcgtggccccggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggactattcgaggattttgaaacacttgatggaaaaggcatcaagaatgttaaagttttggattccacgtcctttttgggtgagcaactcccctctgaggcttccctggtgtgctcacagctcaggatggaggttgtgggagagcaggagcagcagtcatctggtcgacctcgacaatgtgatccatctgggtgcgggacctgccatgactccttccttccccactgcttcctcgtcatgccgcctcaatggcccctgctcaaccgttctgctttccttcatgcacaatcaacccacttcctctgcttagctctttctcctcccatcctaccctttcctccttcaggagagattaggctcatgaaatcaacaaatcttaaaagagcagcagggaaaggggatctcttttgcagttgttcaaaacatcctgcccctgcatggcagctctcctctttctt

SEQ ID NO: 12601 - DNA, 556 bp, Homo sapiens
  ENST00000493611
tgatccagctcaacgacctgtctgtctgcattaacagtagcctgaattatgacagtagtggctgtgctcccaaagggggttaaagtacttgagctatcccttctggaagcacagccccttttgaagacagaagatgctgactaattagcagttccagccgtgctcctcagtagccaagggaaatgcaggaaagaaatcccatcagccaatcccagaaatatcagggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatc

SEQ ID NO: 12602 - DNA, 186 bp, Homo sapiens
  ENST00000476654
agctttcaggctcctttaggactctgatctttcaatgatctgaagaaagctcatactgaaagggccctcatctttgtgtcccatggagccggagagcacagtggccgctatgaagagctggctcggatgctgatggggctggacctgctggtgttcgcccacgaccatgttggccacggacagagc

SEQ ID NO: 12603 - DNA, 410 bp, Homo sapiens
  ENST00000494830
acagctaaaatagtctttaagatgaagtttcctgaaatgatttaaaataaacacagatgggaagggggaaaaactgtaatgaggcacttaaaaaataaagtgagcattttcttaagaacaaatgggatttttcagtcttggagaggtttgcaagaaatgacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatg

SEQ ID NO: 12604 - DNA, 4642 bp, Homo sapiens
  ENST00000265052
cccaaaccaacttgtccccatcaactccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaatggc

SEQ ID NO: 12605 - DNA, 4235 bp, Homo sapiens
  ENST00000398104
acctcgggccgcccccgccgccgagccggcccagggataaagtggcggcgcagacgccgcaccctgtcgccgcgaagccggtcgcgcgcagctcgtcccggccctggcccgccgcaaacgaggatccgctgcgctcggggaacgcgacagcggcgctcgtggccccggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaatggc

SEQ ID NO: 12606 - DNA, 4552 bp, Homo sapiens
  ENST00000453507
cccaaaccaacttgtccccatcaactccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaatggc

SEQ ID NO: 12607 - DNA, 1405 bp, Homo sapiens
  ENST00000539261
tctcccactggttcctcccctctcaactgctctggttcttataaaaacctcacagccttccactaacatcccgtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattacagaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttcttttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaag

SEQ ID NO: 12608 - DNA, 423 bp, Homo sapiens
  ENST00000545199
aatcacatgaaagcatggaatcttatgaacttagatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattacagaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttca

SEQ ID NO: 12609 - DNA, 694 bp, Homo sapiens
  ENST00000228938
cccgtaggagcctctctccctactgctgctacacaagaccctgagactgacctgcaggacgaaaccatgaagagcctgatccttcttgccatcctggccgccttagcggtagtaactttgtgttatggagagtggcagaaagaagaaaacttcggctttgatatcgtttcagttctctctctgaactggcatcgtgcccaggaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattacagaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgat

SEQ ID NO: 12610 - DNA, 1316 bp, Homo sapiens
  ENST00000507170
gtaggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttagtaagtgaatatttaacttctttattcaaatcccttgcattaaagaacctcttcttatttttaaataaacaagatggaaagatatataacagggagggaaaagggggcctcttttggaaaactaaagtaaatttttaaatctaatgactataaaaattgccaaaggagcaattttttaagtttgaagtagtgcaatatgggatttaagctacaggcgacatatttagaagccataaaatctcatttggaaattttaaattggcaccacgtcaactgcacagatggaaaacgaggagtaatgacaaatggtaaagcacagagctggacgccaagtcagctgggagaccacaggcgccacgttaagctgagtgctgttttggtttttttgtgtttttctttcttgtttttttttttgagacagtgtctcactctgtcgcccaggctagagtgcagtggtgtgatctcggctcgccgcaacctccacctcccaggttcaggcaattctcatgcctcagcctcctgagtagctgggattacaggcccatgacatcatgcctggctaatttttgtatttttagtagagatggggtttcaccatgttgtccaggctggtctcgaactcctggcctcaagtgatccacccaccacagcctcccaaagtgccgggattacaggcatgagccaccacacccagccagctgattgctgttgaatagctggatttataaagactgagcataggaggaaatggcacatcactctcatttttaatttattcattatttttatagtgtttaaactgttcatgtatcggcaatctagttatgcttcataaatcctcaggacagagaatttctcctcaaaaggaatttaaaatctaccaagtagaaatacagaaattaagaaaggcaaagtgatcgtccaaactcaaaaccaacaaagcctatatgacaagtctctaagacacatggattgattactgatttcatttgatcaggaagttaatgaaatctactttatactctcctttaatttttgccaatctccgtttatatgagttgcataagttaaggcactttcaaatatatttgtgtcaaggaatattcacggaaatatttccagctatgtgtcgctaaaactgcatttatttattttctgt

SEQ ID NO: 12611 - DNA, 298 bp, Homo sapiens
  ENST00000536371
tcgtgacaaagcaaattgtctggtatcatgaatttggaacaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaa

SEQ ID NO: 12612 - DNA, 279 bp, Homo sapiens
  ENST00000534835
agtccctgcattgcgcgcgacccggcggcgggacaggcttgctgcttcctcctcctcggcctcaccagtggtgtctatgaatccctgagattggaaaaggaggtcaggtcagcacagagaaaggccttaccccaccactctcccgagaggcaccagcatttcacctgcagcctctgggctctgaaccccactttgcatgagaccacatagtgggctgagtctgcagccaccacgatgccttcaggaaatgctagaattcatctagagttccagattaac

SEQ ID NO: 12613 - DNA, 406 bp, Homo sapiens
  ENST00000543076
agtccctgcattgcgcgcgacccggcggcgggacaggcttgctgcttcctcctcctcggcctcaccattccagaccaaaattgaaaaaatggttgacctcacccaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctt

SEQ ID NO: 12614 - DNA, 914 bp, Homo sapiens
  ENST00000396210
cctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaa

SEQ ID NO: 12615 - DNA, 566 bp, Homo sapiens
  ENST00000539036
gcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcaggatggagtgcaatggcatgatctcagctcaccgcaacctctgcctcccggattcaagtgattctcctgcctcagcctcttgagtagctgggattacagaaaaaatcatcagaaaaaccccgtgcagatgaagaggcttgccacttaatgtactgcacagatgtgatcatcagcggttgccgacaatgaaatatacaagtgcacacaaagtgatctggtgaacaagaggtggaatttaatcatcttctgctgacactttgcgaaa

SEQ ID NO: 12616 - DNA, 551 bp, Homo sapiens
  ENST00000537878
attgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtaagaaatttggaggtaatattttcttacttttaagagttggaattctggagagcagttttcttaattttctttttttatttttggtaaagcccaatagcacactgttttatgctgtaagtgaagtatgccatcgtttggcacagatggatctgatgtatttatggaacagttgctttctcctagaaactagtaaatggttttttcattatggcttttacctttttatcattctgctaagcagatgagatattctggaatatcaaagttttcacggaaactttctttcattttggaattaattttgccaatgagggtttagaaaacaatcattttctagacagtt

SEQ ID NO: 12617 - DNA, 933 bp, Homo sapiens
  ENST00000542256
attgcgcgcgacccggcggcgggacaggcttgctgcttcctcctcctcggcctcaccgtttttgccaatccagaagactgtgtagcatttggcaaaggagaaaatgccaagaagtatcttcgaacagatgacagagtagaacgtgtacgcagggcacaggagatcttaggcccagaaaggcagattcagaagaacctacatgtaaatgagactggagtggaaatgagaatggcaggaaatgcatggaaacagacttgtaactgtctcatggcctggtcgtccaaatcccagagtaggttagcctgactgtgctatcacagcataggagcaagacaggaaatggaactgcataaatctcctttcaagagtctgcaatcattacatccaccaacatgcccttggccagagaaagtcacagggctggcctcagaactaaagtgctgggaaatggactcaaccccctcagggagatgaaccgcaaagtcacatggcacaggggcatggatgcacagagggatgaagatttaggccacttatacagtcaatctattgcacttgtccgctttgttatgctagtatgagtttcaattcagacacatgtaaaagcattttataaactttatgacattatgcaattaaaacagcatttattctaatgtgtcataattttatcagattagtggtaatctgtgatatgctcagtatgagagcaatagttacaaactaagtaaaaaacacaatacagggtttgtgaacttggccttctccctctcatttgcaatgtgctgccttaggaagacagatgggacaaggaacaaatatttggacagccttatcgcctctataactaagttggttcccaaactgtgcccagtctgttctcttgaaattataatatgcaccctgctcccaaccaagtgtttcatcaaattt

SEQ ID NO: 12618 - DNA, 700 bp, Homo sapiens
  ENST00000539708
acccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagtcattgtaaagctgttacgattagcatatttgaacggcagagccagaatggggctacaaatgaagtgaaaagtatgctttaccgtgtgcaacaattgtgaaagttaatacatacacatatggaacaattaactaaaaacttaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcag

SEQ ID NO: 12619 - DNA, 1331 bp, Homo sapiens
  ENST00000535309
tcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagaatcaaacaaaccctgagcatttatcttgcctcttctatataaagtttaactcggcataaccaattgctgatgaagaagaaatgtttccttgtagaagcaaaccagtgaataattgaagaaaaaatttatcttttcaacatctaatgagttaatggattcaagcaaagattatccacggctgttaacaacacaaaaagacaatcggaaattagctattactgcgggaagtacccaataccatctatgaaactgtgtggacaaaaacactgacaaaaatctccacgaatctctaattttgaatacaaatttaaagaaaatgcaaaggattaaaatagaccatgatgaagtcagaaaaattcagacagagaaaaatgctccaggaccagaaacccatttcttccgcaaaagcttccaggtagagattgactgaccgagagaacagagacatagagagaacctagagattaaaagaaacttgagcgatttgtcagcattcagttgcaacgtatggatgtgatttgaattctaatttaaaaaccaaagtagaaagtggtaaacaattggggaaatgtgaacaatgatagaatatttaatattaatgaaatatgttaaatattttcagatatgataatggcattgagtatgtaaaaaagagcctgtttttaaagaaatacctctgaaatacagatgatataatatcatctgtatattagatgatattatatatatcagtatcatcagaataaagtaaggttagcatgaattgttaattgttgacactgtgcaataggtacgtggataattactatactgttctcattccttttatttatgtttgaaatgttctaaaattaaaagttaaagcatagagtgtaaagttgagcaaattcctccaagacctaaatatagcttatcaaaacttacattaattagatgctgactgttgagctaatacttttttttaatgatgtgtgcttcagtttattgcacttttcaaatactccagttttttgtgtgcgtgtgttttttaaattttattattattaaagttttagggtacatgtgcacaa

SEQ ID NO: 12620 - DNA, 546 bp, Homo sapiens
  ENST00000540056
ggcagatggaagacttgggggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttgg

SEQ ID NO: 12621 - DNA, 365 bp, Homo sapiens
  ENST00000540126
ggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttg

SEQ ID NO: 12622 - DNA, 202 bp, Homo sapiens
  ENST00000538885
gtacctgtgaaggggaagatgttaccctggagagatggttcattgactcatcagattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaag

SEQ ID NO: 12623 - DNA, 909 bp, Homo sapiens
  ENST00000396207
gaattcaagtcctaaagcctacagttttgaatactactgaaatgacaagttattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatg

SEQ ID NO: 12624 - DNA, 535 bp, Homo sapiens
  ENST00000538857
attccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagggcacaggagatcttaggcccagaaaggcagattcagaagaacctacatgtaaatgagactggagtggaaatgagaatggcaggaaatgcatggaaacagacttgtaactgtctcatggcctggtcgtccaaatcccagaggatggagtgcaatggcatgatctcagctcaccgcaacctctgcctcccggattcaagtgattctcctgcctcagcctcttgagtagctgggattacaggttgctgcagaagtcaagagctaaccaagaagacaaggaatgtaacatattta

SEQ ID NO: 12625 - DNA, 655 bp, Homo sapiens
  ENST00000535624
ctgcctcagcctcacaaagcgctggaattacaggtgtgagctattgctcctggccagtatttgaaataagttttttttcttggtatttggataggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttt

SEQ ID NO: 12626 - DNA, 1842 bp, Homo sapiens
  ENST00000624056
tatcaaattctccatttctagcctagattctaaagcaatttctaattctgtagacttaagggaggtgacattttaaaattaagtatttttaaaaatgttgctgggcatgatggcttgcacctataaacccagtgttttgggaggctgaggctggaggactgcttgagaccaggtgttcaagaccagcctgggcaacatagcaagaccccatctctaaaaagaaaatttaaaaaattagccaggcatggtggtgaggcctgtagtcccagctactcatgatgctgagactcaggagtttgaggctgcagtgagctatgattgtaccactgcacttcagcctgagcaacagagcaagaccccctctctaaaaacaacaatagcaatgacaacaataataataaaaatgtcaagtccatagtagatgtgttttgtattcggtcttagccagagaaacccaagatgccacggtttggagcaaaactgtggctaaaacatgctttttgttttcttctagctctgttataaagaaaacatttaggaaattctctctttctctctttcacctatcctactttttgtgtgtcctttgtagttttgcaccatcattcctaacgaatttatttggcatttggaagataggttagcaaaaattttactatatttgaaaggctagttatgtattctgttatttagatataagagcatgagagtcttgatattaaattggtaaattaattattggcaacctagtggtttgggttggcaaggattctgtcaataatcatttggtagagtagcagaagcaaaggaggtgtcttaagaaaaatcaacaccaaaagggttttcttccttcgggagaaagaatttttataaaaagaatcttgaattgctaattgttatgaacctcataagaaaaaagtatttttatttacaaaaatgaaatgagttctattagatagatgtcgttttgatattctaggaactacaaaatgccttctgtgatatttaaagatacactaaaaataaaaagaaacagaaataatgagagattctaaataaaagtcaagtgggcaaggaagcaagacaatttgagagaaaaaaaataaatcttactttgaaatttaaggatccattagtgctcagatttagtttttagaagagagagaaaaaaggatacatatctagtattttgaaattagtgtctttaatagttatctttttccacagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatg

SEQ ID NO: 12627 - DNA, 2152 bp, Homo sapiens
  ENST00000359720
acaactaactcagcaatggtgggcgcccctcccccagcctcgctgctgccttgcagtttgatctcggactgctgtgctagcaatgagcgagactccgtgggcatgggaccctccgagccaggtgcgagatataatctcctggtgtgccttgttttaagcccattggaaaagcacagtattagagtgggagagacctgattttccaggtgccgtctctcacccctttctttgactaggaaagggaattccctgaccccttgcacttcctgggtgaggcgatgcctcgccttgctttggctcgtgcacggtgcactgcacccactgacctgcgcctactgtctggcactccccagcgagatgaacctggtacctcagttggaaatgcagaaatcacccgttttctgcctcactcacgctgggagctgtagaccggagctgttcctattcggccatcttggcttctctctgagctaatacttttaaaatattttgcactccacagaggaaggttttatatgtaagtctgagttttgtttttctgagttgttttcagttggtccatgtgattacatttttatacatggtaaaaatttatatatttttttccaagtctttttctttttcttttcttttcttttttctttttatttttgagacggagttttgttcttgttgtccaggatggagtgcaatggcatgatctcagctcaccgcaacctctgcctcccggattcaagtgattctcctgcctcagcctcttgagtagctgggattacaggtctagtggcacttgaatctttagcacaacagggagcctctgtgcccagggttcagtggcttccaggaattcttcccagaataaacctcaacattctgcagtcttcatgggtgctggcgcaagttgcttttcaagttcttcatactctactgacctcagacttcttctcagcccgaggaaaacagcttcctcttcctcctggccattcaccaagacacaccattctcttctctccttgtccagggcgcttagcatggtcacttccaaagtttgtgcattttcaaaagaaaatgaagacatccttccatgctgttgcaaacatgccctgaggcaagaaatcacaaaggctctttggaaaacaggaataagtgactgcaggtatgacagaaagtgaaacagaataaatgaaaattaacgccccacagatgtatttatccacaaattttatcataaggtgacttgttggtagtcacataaaaagtagaaaaaaacccctctgaatcaagtattttaaagtattcctgggtatctttcctctaagtctcagattatccacacagggtccacatagttttaagaatagttggcatgcctaggcttaactctgtgggacagtaaatttttttaaaaaaaagcttttgcctgctcttggaagacaatattgtgttcaatatagtgcagtgctccacagcttgtaaaatcaactatgtggcacaaatctgaagacgtcttcaaaagatatatggcaagaaagatatgttgccggctttagtcatctttgccatttctcttatggaatttcactatagtggctggacatgtgcaacccacatcctgtctggccttaatgtgatttttctacaaaaggagaggaggacaaaagtaaaagcaaaatatgctttacaatgaaaaatgcaaccctcagccactgggataaaattacattgacagtgggggagttattttcttccttcaaagaacgatgtttgatgttccaactagactctatggtgatgaagctcataatttgggagctgaatcagattcgaatttagaaaaggggtttcagacgttgcttagcagggtgattttaggggttaacatatgaatagagattacattataactcatctgccctgtgtttgttggacacagcttatatgacctattcctgatggttgctcatagaaggatatttaaattctgttgtaattcttccttataaaatctgtgacattctaatagatagaaaatgtttaaatcttgtctagtttctgcttcgtttccttctttatgttgatttcttcctatttatctcttttgtgcatcacacatatttcactataaactcgatttttgtgggtgaaaggccac

SEQ ID NO: 12628 - DNA, 901 bp, Homo sapiens
  ENST00000010404
tcgtgacaaagcaaattgtctggtatcatgaatttggaacaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatg

SEQ ID NO: 12629 - DNA, 979 bp, Homo sapiens
  ENST00000396209
ggcagatggaagacttgggggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatg

SEQ ID NO: 12630 - DNA, 962 bp, Homo sapiens
  ENST00000421867
caggctggagtagacaggaaccacgagaggcagggaggactgtacaggggttgctgaccaggtggaagatgatgggagcctcagaaggtgtcgtgggacagggtcagggagagggctctatgcggccaggatctggatgcagattgttgagactgaaatttggctcagatcccttctagttgtgtctgtttatcttcagtttccttgtctataaaatggggagagattgtgtgtccccggcatcactggactgttaatagctattgcatttatagcatttatcccagaacctgaaacacagtaaatgctcagtaagtgttattatttgccccaaactgtcttagtgctttccccaagagctttgtgttgtttgtactatgaggaataatgagggtggtgtgggagtcggcctctgtgtctgcagagaggaccacaggccacaggaatagagacaggtagataggatcaaggtgacaggaacagatgttcagagcaagagatgaagacggcatcatcaacccagacaagccagttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctga

SEQ ID NO: 12631 - DNA, 586 bp, Homo sapiens
  ENST00000418918
aaaatggggagagattgtgtgtccccggcatcactggactgttaatagctattgcatttatagcatttatcccagaacctgaaacacagtaaatgctcagtaagtgttattatttgccccaaactgtcttagtgctttccccaagagctttgtgttgtttgtactatgaggaataatgagggtggtgtgggagtcggcctctgtgtctgcagagaggaccacaggccacaggaatagagacaggtagataggatcaaggtgacaggaacagatgttcagagcaagagatgaagacggcatcatcaacccagacaagccagttggaggcatctgtccacccatgtggttccagacacgttcatgtggccaccatgaccccgtcggcatcacaggggtaaccaaggtccacagaacgaggggaaagggtcactgtggatcaagccaggctcctctgagcagtccagggtctatttacagagagcagcaagttcctgggacagaggagacagaagggaatttccaggttcttcaggacgttcacaaccacactgagaagcatctttgcagataagtatttaaacttacc

SEQ ID NO: 12632 - DNA, 543 bp, Homo sapiens
  ENST00000440347
agcttcaagatttagtcattcttctggcaaacatatgtggaaggcctccggggtagcacacccttcaccgtgccctggagatgctgggatgcgacaaaaaagtaggcttctcccatgatgaacctcacggatggagtttcgctcttgttgcccaggctggagtgcaatggtatgatctcgactcaccgcaacctctgcctacccggttcaagcgattctcctgcatcaccctccagagtagctggtattacagttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcat

SEQ ID NO: 12633 - DNA, 579 bp, Homo sapiens
  ENST00000450203
agtcattcttctggcaaacatatgtggaaggcctccggggtagcacacccttcaccgtgccctggagatgctgggatgcgacaaaaaagtaggcttctcccatgatgaacctcacggttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaa

SEQ ID NO: 12634 - DNA, 593 bp, Homo sapiens
  ENST00000430483
attcttctggcaaacatatgtggaaggcctccggggtagcacacccttcaccgtgccctggagatgctgggatgcgacaaaaaagtaggcttctcccatgatgaacctcacgggtcctttctctggctgtgatccatgcttcttcccagggcaggattacactctttgaatttacttattcatcaagacagtgcagagtggtggaaagagaagcagctgagagttacgcagttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgatttt

SEQ ID NO: 12635 - DNA, 628 bp, Homo sapiens
  ENST00000439738
agcgccgcgggtggggatgcgggaggctgagcgcaccggccagctagcccctttgtgcggcgggggctgcggagtgctccctccaagaccggttgcaccccgctttcctggccaggactctgggcgcggttggaggcatctgtccacccatgtggttccagacacgttcatgtggccaccatgaccccgtcggcatcacaggggtaaccaaggtccacagaacgaggggaaagggtcactgtggatcaagccaggctcctctgagcagtccagggtctatttacagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaag

SEQ ID NO: 12636 - DNA, 594 bp, Homo sapiens
  ENST00000422403
gcgcaccggccagctagcccctttgtgcggcgggggctgcggagtgctccctccaagaccggttgcaccccgctttcctggccaggactctgggcgcggcagctacaaagacgacgccggctgcgctcgcgggaccagagggagggaggctgcggacgagtgcggggaggagtttgagatgggaggcgcttgcaggggctcccccagttctgcgctgtgagccggggcacaaagagccctctgcactagcgccgcaggaccgcggacccgagttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaaga

SEQ ID NO: 12637 - DNA, 847 bp, Homo sapiens
  ENST00000436238
gcgcaccggccagctagcccctttgtgcggcgggggctgcggagtgctccctccaagaccggttgcaccccgctttcctggccaggactctgggcgcggttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagtttcagcactttgtgatcatatttataaaccttggacagggctccttggccttagagttaagtgaagagttaacactgtgactttagatgcatttttctcagtgtaagtgtctgagctcatctccagttctggactcgtgcccccactcccgggtgctgacagcaagctctgaagatatgctgagagagctccctgactctcctgactcaggtctgccagttgatg

SEQ ID NO: 12638 - DNA, 567 bp, Homo sapiens
  ENST00000425476
agctagcccctttgtgcggcgggggctgcggagtgctccctccaagaccggttgcaccccgctttcctggccaggactctgggcgcggttggaggcatctgtccacccatgtggttccagacacgttcatgtggccaccatgaccccgtcggcatcacaggggtaaccaaggtgatcctccctctcttcctgtgtccactggggatggtagagaccagcttaatgctttgagatcagatccatcacgaaatccgtatgtcctgagacctcctgaatcttaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacact

SEQ ID NO: 12639 - DNA, 612 bp, Homo sapiens
  ENST00000455640
gtgcggcgggggctgcggagtgctccctccaagaccggttgcaccccgctttcctggccaggactctgggcgcggttggaggcatctgtccacccatgtggttccagacacgttcatgtggccaccatgaccccgtcggcatcacaggggtaaccaagaacgaggggaaagggtcactgtggatcaagccaggctcctctgagcagtccagggtctatttacagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctatta

SEQ ID NO: 12640 - DNA, 568 bp, Homo sapiens
  ENST00000451141
gtgcggcgggggctgcggagtgctccctccaagaccggttgcaccccgctttcctggccaggactctgggcgcgggtccacagaacgaggggaaagggtcactgtggatcaagccaggctcctctgagcagtccagggtctatttacagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtga

SEQ ID NO: 12641 - DNA, 894 bp, Homo sapiens
  ENST00000452429
ggcgggggctgcggagtgctccctccaagaccggttgcaccccgctttcctggccaggactctgggcgcggcagctacaaagacgacgccggctgcgctcgcgggaccagagggagggaggctgcggacgagtgcggggaggagtttgagatgggaggcgcttgcaggggctcccccagttctgcgctgtgagccggggcacaaagagccctctgcactagcgccgcaggaccgcggacccgagttggaggcatctgtccacccatgtggttccagacacgttcatgtggccaccatgaccccgtcggcatcacaggggtaaccaaggtccacagaacgaggggaaagggtcactgtggatcaagccaggctcctctgagcagtccagggtctatttacagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagtttcagcactttgtgatcatatttataaaccttggacagggctccttggcctta

SEQ ID NO: 12642 - DNA, 1041 bp, Homo sapiens
  ENST00000413665
attaaaatttcatgggcgctgcagcagctacaaagacgacgccggctgcgctcgcgggaccagagggagggaggctgcggacgagtgcggggaggagtttgagatgggaggcgcttgcaggggctcccccagttctgcgctgtgagccggggcacaaagagccctctgcactagcgccgcaggaccgcggacccgagttggaggcatctgtccacccatgtggttccagacacgttcatgtggccaccatgaccccgtcggcatcacaggggtaaccaaggtgatcctccctctcttcctgtgtccactggggatggtagagaccagcttaatgctttgagatcagatccatcacgaaatccgtatgtcctgagacctcctgaatcttaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagtttcagcactttgtgatcatatttataaaccttggacagggctccttggccttagagttaagtgaagagttaacactgtgactttagatgcatttttctcagtgtaagtgtctgagctcatctccagttctggactcgtgcccccactcccgggtgctgacagcaagctctgaagatatgctgagagagctccctgactctcctgactcag

SEQ ID NO: 12643 - DNA, 10069 bp, Homo sapiens
  ENST00000616469
catgggcgctgcagcagctacaaagacgacgccggctgcgctcgcgggaccagagggagggaggctgcggacgagtgcggggaggagtttgagatgggaggcgcttgcaggggctcccccagttctgcgctgtgagccggggcacaaagagccctctgcactagcgccgcaggaccgcggacccgagttggaggcatctgtccacccatgtggttccagacacgttcatgtggccaccatgaccccgtcggcatcacaggggtaaccaaggtccacagaacgaggggaaagggtcactgtggatcaagccaggctcctctgagcagtccagggtctatttacagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagtttcagcactttgtgatcatatttataaaccttggacagggctccttggccttagagttaagtgaagagttaacactgtgactttagatgcatttttctcagtgtaagtgtctgagctcatctccagttctggactcgtgcccccactcccgggtgctgacagcaagctctgaagatatgctgagagagctccctgactctcctgactcaggtctgccagttgatgaagacagcacagttgttaccaaaaacaaaacctggcagatggtcctaggtcaggattagtggtcattctctggtcttctccagactggtgacacagggtggtcttaaaagagtcctagtccagcctctggctccccgaatttcctctggtgcatggggcatcaggaaagggcaggggagaaggagggggagcagaaaaataactgaggctgggcagaagggtcccttccatttcccatccattgcttcaaacaatgggtgattaccgtgcaccttgagtgaatgtcaaggcaggaagggttccagggccacccagtgtggcaggagcagagctgggatcagaattctggattcctgactctccgttcagctgctattcagctatcaccaagctgctgagtttgtcctactttctcctgggtcacattctgctgttgttgggaaacagggagtgagtgaagggaacctgggaacccttctcccctcaccttttaaggatgttctggggtggaataaagagaggtggagggtggggtgcctgggcccagcctccctggctcctggtccttctttcttcagcagggagttctggcaaggcctgggcctggggagggggcctgggtgcagttttctcctgcggtgtggttggctcttttgtcttccaggatgggcctgtggggtctgtgtggggaaggaaggagctgggagcctgggctgcctgtgtgtcggctggatgctgccaggtggctccatctgggccgcatctccaggactcctggcctggacttctctttggacctcgggtgaccttggattctggccacagtgacttagcggtcagactccggtggttttctagcccgctgggtgactccctgaagatctcatcctcttcacacctgttgggatggagcctcccatggataggaactcttcctggttgatgctcagcagatgactgatctggctctggaggacagctccaggggtatgagggaggcctggcagcccactactccctcctcacctgctcgggccctgcctgctgggccctattgtctgggtctgggggccctttcctgccccatgtgaacttgattcctcctcgcgtttctgccggtgaccagacagagcctggcctgggccaagtccccactgaccacactttccccaaggctgggtctcaaaggaccctacaggatggggacaggaacaaggatgggagtcggggaggggctgtcaggcagagggcagatgcagctcctcgggtgccgctggctggagtcctttgtctccatttgctcagtgcgtaattgtcattttgtgggggacttccttggtggggcttttccatgcttttcctctccctgatggttacaaagaggagacagtcaggatctgggaggagctggagccttccccctgtgctgttgaactctgggaggggcagccagaggggctgagagtgcaccatcctgaaaagagagggtctttaagagataagatttaggctagggaaattcactagaaagagacaggtggccctgggttttttttcctgccatccaaagggaaccagtcttacccaaaggcttaaggggtcaccttagcccagtctcaggacactcttctccaatcagatcgctgcttctagttgcactgctcctggattctgttcttggggaacagaaggtggcaggacaggccccacaatctgcaattccagctccctccagaggagacagtcccagcgtttgcaagagagcagcttgtggcctcccttaggcaagtttaaaagccagatgtcctttttcccagaatgcggagtggtgtgtactattcatcagcttgggctgccacagcaccatgccagactggatggcttaaacatcaggaatttattttctgccagttctggaggctggaaagtccagatcaaggtgttaagacttggtttctggtgaggcctctctccttggcttgcaggtggcaccttctcactatgtcctcacatggccttttctctgtggagagggacagagagcatgagcaggctctggtgtctcctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaggaggagcagagaggtatgggaagcagacacggagagtggcaggtaccatgctggggtggctcaggagtgcttcggaggacatatggaactggcagggctcagtgcagggaggcggaggccctgggagagccgtgtcctgagaagggcctgggctacaaccctgggcaagttacttcacctctgagcctccgatgctctgtgaaatggaaggaatgtgcttgcctgtcaggtgcagggagaattcagtgagattgtgtgcctagcacagtgcctgactcccagtaggtgctcagcaaatgctcccatccatctgggagtatagacttagggtttatctatttttttttttttttggctctctggactttaaaactcagcatcttctgaaccagaggcatttctgattagcccttccctacctattttcctagtatcactctttaatcagcttggggaggtggcagcatttcatggcctccgtagtaactcacaatgcttcctggggtatttaaattctactctctcatcagcactgagcacctactttgggccctttcccgtgctagccatttgggggaaatataggtgaagagtggctggggtttgaacctttaggatttcacagccatgctggatgggataaaaccagctcacatggagaatcagagaatgggacagtgccacaaaacagtctactgaggcacaagttctgagtgcctgggaagtggtagagagaccccagagagggctgctgcagtctggaacagcttcctagcaagctgtaccaaacagggccttgaaggatgagaaagatctggctgagatgatacccgaccctctagggaaattcttaaagtaacttctaggaaatgtcattgctccttaaaaaaaaaaaaaaaaaaaaaaaagcaggttctaattcaaattccgctgcactactgaagtagtgcaggacttatcagaacctttaaaatgctaatggcaatttcaaatactcagggacagggcataggatgaagtgttccttgacttttatggccgtagaatctttttctcatggaacatcgtttagaactgtgggagatgctaggctggggtttctatgggaaaagtacagcagtgatagaagatggcataattagggtacacttaggtgctttgtagcattggctgaaaaggaagcagaccgggtgggcgtgggggagtctcaacttggttccaggagccaggccagcttgatgcgttttttttttttctaatggtgggagggcaggccaatagttggagaaactagaggcctgacagtcggtgatggaagagatgtctactaagcacggttgtcagatcttttgcggagagatgcgggtgtgcgtgtgtctgtcagagtgtaacaggatccagccctctgggaaggggctgaccagaaccaggcagggggtttctgtctaggacaagtagggtccattttcaggggagctgaaatatttgcagggggtgctctgagacccacagccaataaatagggaagcaacatgcttttgggcagggtccatgtggttagggttgattttgatggggctggggggcttagagttagaccccctgccctggtcaggccccactccctggctggtgggggcgggaggcctctgaagctgcagctggaggggccggggcagtgttgcatggtgtgattaacctactaacccagggctcagccgggacgctgtggcgtgtgacgaggtgcctggccttctgccaaccaactaacccactaaccaggcccgagcatgccctactaaccacccccccgcagccagatcctactaactgtgcagctcatgggcctttcaaggggctgggatatgggggcagccaaggctccagaaggctctgcctatgggctgggatctttgtgcagacccacgttccaggacagagaatgcaaataagactcaccaactctgccacttcctgttgagtgagtttgagtaagtcacctcacttctctcaacctcagtttcctcagtggtagaatgcgagttctgataccttacaggttgcagtgaggattcccgtcaatataagggtctcagcacatggcagacacctaaaaaaaaaaaaagtatgaggatggaggaaggcccctcaaacctggttgaacacgtctgctgcctaggccctggcctctctgggtgttctgcacacagatccttctgcctggggcaagacacttggctttgaatccatgtcacttccccacattcttcctccgtctcagctttcttttctgtaggcagctcttttgttcgattactaacccgtctaacccctggggtgcctcaactgcaccccgatcatcccttaacaaactaacggacctgcgtgcgttcttccttttctcttagcgactcctgtgtgtgtctgctgaggtgccctgtccgctggtgctgtgctctgacttactaacccagcccctactaaccctgttttctcttcttactaaccccagccctgccgagctctgggctccccccgggggctggtccccctccttttggcaagcagatgacctggggctactggccctgtagacagatgtcccactttgctgccccatattggctgtaagatcagagtccactgggccaggtctaaggcaggggatggccctattaacaagactcagaggaggaagaggtggtcctgtggatgtgggaggctggactctgagtatgacatctctcctatgtgcagaagtctggttgccactgggagtaggtgggaccagggaaatctctgggacgtgagtgtggaggcctgttggtctagactctagactgtggagctctgagcttttgtgtcctctggaaggaagctggggaagaatcctctccattgttaagtgacggggatagaagctgtcctgcacaggaagtcacgaggggggcgtatcccacgaggaaggcaggagggggcgtgcccctcaccggaaattagcagaggggcgtgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtaagtagacgtggggccgtgaccggaagtccttgggaaagatccgtcccattcccggaagctagagggcgttagttgtcgggttgaaaaggggtgtggggaggggaagcagctttaccccgggctcggagtttgcaggagagagaagtggggagcaagaagtgaacctcaggggctcacagggttcccgcagatgctcaggccggccaggaatgcatctctggctctctgttcccacggacgtcactgcctcagccagcctcccccagagcccgccagccgctaagccggggccacacctgggggtgatttcatgcctcacctccagtaggcaccttggtttctttgggctaatctctggctcccttgcgctaactcttgctctcacccagctaatccctgcctcaccctgactgccccaggggctgaccactaacaaccaacctggccctgtctgggggttccaggctcctggcctggccctgaccggttcttaattaacctttccttcaccttgactaactcctgccttcctggtctgttcctttcagcagaaactaatggtttgtggatttttttctgactaacaacaggtctaacattcctcgttactgttaacagcttggatgtcggcatggctgggaaggggctaacacagctttgaacttggctaacacaggtttgaacttggctaacacaggtttgaacttgactaacacagggaaaagcatagctaacaattttgggcgtggtggctgctctgagtcagaacaatcagaagtcggtaaagatggtagttttctaaaggaggtgccagggctctggtgtggaccaggcctgatggagcagtggtacccaccaaggtggggtcagaagtatagccagtcttgcaaggttttggccattgggcatatcttcactcctcatagtctgcatttggtttcagttcttaaaaaaatatagccttatagctacagtagtttgcacaagtagatgcagctcttataaaccttaaaatacctgtctggtgtctacagagcatatgccattttgtatagagtcacccttccccaggccagggcctagagtcttcattttggggactttgtgttttggaagttctaggacataaagctttagatcagagtattcagaagggttataactccgtcagtcatttacatgttagtagtataaattatctgagcttcctgttctaacttttagctcttctagcataaactcttctgtgcaatttagctgcaccgaggaaacgggagtttttctggaagggacttttgatctctttagactgagggaacgtcctttgggagtagaggggcagggagcatacgcaagggattccaggtgcaggtaaaaggtggcactagttcaaggttttgctgactcagtctggtagtcagagtctgcaggagaagacagttcaaggcagggcctggaggattggatcagtttagggacaggtcaaaggctggcttacagaccttagaggcaggttgcttgggtcgttgaatgctagtctggtgctgagagcccttttctctggcaactgtggactcagagctaaccaattgtagttggcagtgggggtgaagggtgatccagaggcctgagctgcagagggcacaagagagaaaagatgtcttagaaagagctttgagaacatgccttggctgctggcagggaccttggatggggtagtctacacccggaagtgcctgcctgccatcctctagtggctgccttgctccatttcactcaaagcaggaagctcacacctcctattcctgaaactcctctttgtttaactgcaaagacttgatgctgctaaggatctactatgtgccaggcactgctctgggcgctgggacctgcacctgggctttttcgtcatggtgcttttatagcctagtgggagagttggtgaagtagatagtgattcagtgagatgggtgttatgattggtcaggggtctgtgggagcaccaaggagacagacaagattgatgtgcacctactctgtgccaggcgtgtgccaggcattggggatgtagtggtagttaaacaccatttggtcttcaggagctttaattctagtgtgttgggtgcaggggggtggaatggggacagagagacacctaatccaccctgtggtggctttctggagagggaggcatctaagctgagctgtggctgggtggagtgtgggtggggatgagttccgggcagcgagagtggtggacaccagtttctggggatcagagaggatccaaagaggttctggaaggttcatgtggaatgtagcaagagataggagacatggacatggtgccgggtctggttgccaagaagtttagattttatccttaggccttggggagcgacggatatgatctgagaaagggagttagtggatttgagttttaggctggccatttggcttttccagcccaggtggaactcagaggagtttgcaatggcctctggccacattttagacaactgagcagaactttttgaaactaggaagaccctttggtccatcttttgataaacagaatccatacatgtctaccccagttggaagtatctctgcaatgactggaaagtaaagaggaccaaggtgaaaataaaggctcggaaggggagcaatcttgaaaacatgtcatcccatggtggtgggaagtccctggagaagatcaggggaaacacagtcataggctgcaagtctataagataattccattggggagggagcccatttgtcatgcatggctgcaaggggcagatacaagtgtggagtaagcttgcaagagctgatcctggtcccagagagggaaaaatatgccttggtgggtaatgaaccttttgttcccagaggcagaaggattgggactaggccaacatagagattggcgatggttgtgagattctaagagtgtgtgtgcatcttgacaatattagaggaggctgagcccaagcaggcacattctcttcgacccctccctcattcagtctgctttggagtctactgaacatcaagcttgctatgagcaggatcttagagctgaggaattggcctcccaatccgaacaggtgttataatcctttcttaataggttgtgctgtggacccaatgtgagggctgtgctggtgtaaatggtgacatgttgagctggggggatgctttcggggtggggggactggttccattccatcaaaggccctcttgagagtctatccagggacccattgttttactttaacagaccagaaaagatgtttgttttccatgtcattacccccaggggataccgaatgtgtgggtagaaatttctctgtagattaaaaatcagatttttacatggattcaacaaaggagcgtcacttggatttttgttttcatccatgaatgtagctgcttctgtgtaaaatgccattttgctattaaaaatcaattcacgctgg

SEQ ID NO: 12644 - DNA, 10069 bp, Homo sapiens
  ENST00000620145
gagggagggaggctgcggacgagtgcggggaggagtttgagatgggaggcgcttgcaggggctcccccagttctgcgctgtgagccggggcacaaagagccctctgcactagcgccgcaggaccgcggacccgagttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagtttcagcactttgtgatcatatttataaaccttggacagggctccttggccttagagttaagtgaagagttaacactgtgactttagatgcatttttctcagtgtaagtgtctgagctcatctccagttctggactcgtgcccccactcccgggtgctgacagcaagctctgaagatatgctgagagagctccctgactctcctgactcaggtctgccagttgatgaagacagcacagttgttaccaaaaacaaaacctggcagatggtcctaggtcaggattagtggtcattctctggtcttctccagactggtgacacagggtggtcttaaaagagtcctagtccagcctctggctccccgaatttcctctggtgcatggggcatcaggaaagggcaggggagaaggagggggagcagaaaaataactgaggctgggcagaagggtcccttccatttcccatccattgcttcaaacaatgggtgattaccgtgcaccttgagtgaatgtcaaggcaggaagggttccagggccacccagtgtggcaggagcagagctgggatcagaattctggattcctgactctccgttcagctgctattcagctatcaccaagctgctgagtttgtcctactttctcctgggtcacattctgctgttgttgggaaacagggagtgagtgaagggaacctgggaacccttctcccctcaccttttaaggatgttctggggtggaataaagagaggtggagggtggggtgcctgggcccagcctccctggctcctggtccttctttcttcagcagggagttctggcaaggcctgggcctggggagggggcctgggtgcagttttctcctgcggtgtggttggctcttttgtcttccaggatgggcctgtggggtctgtgtggggaaggaaggagctgggagcctgggctgcctgtgtgtcggctggatgctgccagcaccggcatggaccaagcaacttctctgagccagatgctggggacgcagaggtgaacccagagacatgatcccatctgctcagatcttcatgtcagaacacgctttattacagtctcggcaagggggtggctccatctgggccgcatctccaggactcctggcctggacttctctttggacctcgggtgaccttggattctggccacagtgacttagcggtcagactccggtggttttctagcccgctgggtgactccctgaagatctcatcctcttcacacctgttgggatggagcctcccatggataggaactcttcctggttgatgctcagcagatgactgatctggctctggaggacagctccaggggtatgagggaggcctggcagcccactactccctcctcacctgctcgggccctgcctgctgggccctattgtctgggtctgggggccctttcctgccccatgtgaacttgattcctcctcgcgtttctgccggtgaccagacagagcctggcctgggccaagtccccactgaccacactttccccaaggctgggtctcaaaggaccctacaggatggggacaggaacaaggatgggagtcggggaggggctgtcaggcagagggcagatgcagctcctcgggtgccgctggctggagtcctttgtctccatttgctcagtgcgtaattgtcattttgtgggggacttccttggtggggcttttccatgcttttcctctccctgatggttacaaagaggagacagtcaggatctgggaggagctggagccttccccctgtgctgttgaactctgggaggggcagccagaggggctgagagtgcaccatcctgaaaagagagggtctttaagagataagatttaggctagggaaattcactagaaagagacaggtggccctgggttttttttcctgccatccaaagggaaccagtcttacccaaaggcttaaggggtcaccttagcccagtctcaggacactcttctccaatcagatcgctgcttctagttgcactgctcctggattctgttcttggggaacagaaggtggcaggacaggccccacaatctgcaattccagctccctccagaggagacagtcccagcgtttgcaagagagcagcttgtggcctcccttaggcaagtttaaaagccagatgtcctttttcccagaatgcggagtggtgtgtactattcatcagcttgggctgccacagcaccatgccagactggatggcttaaacatcaggaatttattttctgccagttctggaggctggaaagtccagatcaaggtgttaagacttggtttctggtgaggcctctctccttggcttgcaggtggcaccttctcactatgtcctcacatggccttttctctgtggagagggacagagagcatgagcaggctctggtgtctcctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaggaggagcagagaggtatgggaagcagacacggagagtggcaggtaccatgctggggtggctcaggagtgcttcggaggacatatggaactggcagggctcagtgcagggaggcggaggccctgggagagccgtgtcctgagaagggcctgggctacaaccctgggcaagttacttcacctctgagcctccgatgctctgtgaaatggaaggaatgtgcttgcctgtcaggtgcagggagaattcagtgagattgtgtgcctagcacagtgcctgactcccagtaggtgctcagcaaatgctcccatccatctgggagtatagacttagggtttatctatttttttttttttttggctctctggactttaaaactcagcatcttctgaaccagaggcatttctgattagcccttccctacctattttcctagtatcactctttaatcagcttggggaggtggcagcatttcatggcctccgtagtaactcacaatgcttcctggggtatttaaattctactctctcatcagcactgagcacctactttgggccctttcccgtgctagccatttgggggaaatataggtgaagagtggctggggtttgaacctttaggatttcacagccatgctggatgggataaaaccagctcacatggagaatcagagaatgggacagtgccacaaaacagtctactgaggcacaagttctgagtgcctgggaagtggtagagagaccccagagagggctgctgcagtctggaacagcttcctagcaagctgtaccaaacagggccttgaaggatgagaaagatctggctgagatgatacccgaccctctagggaaattcttaaagtaacttctaggaaatgtcattgctccttaaaaaaaaaaaaaaaaaaaaaaaagcaggttctaattcaaattccgctgcactactgaagtagtgcaggacttatcagaacctttaaaatgctaatggcaatttcaaatactcagggacagggcataggatgaagtgttccttgacttttatggccgtagaatctttttctcatggaacatcgtttagaactgtgggagatgctaggctggggtttctatgggaaaagtacagcagtgatagaagatggcataattagggtacacttaggtgctttgtagcattggctgaaaaggaagcagaccgggtgggcgtgggggagtctcaacttggttccaggagccaggccagcttgatgcgttttttttttttctaatggtgggagggcaggccaatagttggagaaactagaggcctgacagtcggtgatggaagagatgtctactaagcacggttgtcagatcttttgcggagagatgcgggtgtgcgtgtgtctgtcagagtgtaacaggatccagccctctgggaaggggctgaccagaaccaggcagggggtttctgtctaggacaagtagggtccattttcaggggagctgaaatatttgcagggggtgctctgagacccacagccaataaatagggaagcaacatgcttttgggcagggtccatgtggttagggttgattttgatggggctggggggcttagagttagaccccctgccctggtcaggccccactccctggctggtgggggcgggaggcctctgaagctgcagctggaggggccggggcagtgttgcatggtgtgattaacctactaacccagggctcagccgggacgctgtggcgtgtgacgaggtgcctggccttctgccaaccaactaacccactaaccaggcccgagcatgccctactaaccacccccccgcagccagatcctactaactgtgcagctcatgggcctttcaaggggctgggatatgggggcagccaaggctccagaaggctctgcctatgggctgggatctttgtgcagacccacgttccaggacagagaatgcaaataagactcaccaactctgccacttcctgttgagtgagtttgagtaagtcacctcacttctctcaacctcagtttcctcagtggtagaatgcgagttctgataccttacaggttgcagtgaggattcccgtcaatataagggtctcagcacatggcagacacctaaaaaaaaaaaaagtatgaggatggaggaaggcccctcaaacctggttgaacacgtctgctgcctaggccctggcctctctgggtgttctgcacacagatccttctgcctggggcaagacacttggctttgaatccatgtcacttccccacattcttcctccgtctcagctttcttttctgtaggcagctcttttgttcgattactaacccgtctaacccctggggtgcctcaactgcaccccgatcatcccttaacaaactaacggacctgcgtgcgttcttccttttctcttagcgactcctgtgtgtgtctgctgaggtgccctgtccgctggtgctgtgctctgacttactaacccagcccctactaaccctgttttctcttcttactaaccccagccctgccgagctctgggctccccccgggggctggtccccctccttttggcaagcagatgacctggggctactggccctgtagacagatgtcccactttgctgccccatattggctgtaagatcagagtccactgggccaggtctaaggcaggggatggccctattaacaagactcagaggaggaagaggtggtcctgtggatgtgggaggctggactctgagtatgacatctctcctatgtgcagaagtctggttgccactgggagtaggtgggaccagggaaatctctgggacgtgagtgtggaggcctgttggtctagactctagactgtggagctctgagcttttgtgtcctctggaaggaagctggggaagaatcctctccattgttaagtgacggggatagaagctgtcctgcacaggaagtcacgaggggggcgtatcccacgaggaaggcaggagggggcgtgcccctcaccggaaattagcagaggggcgtgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtaagtagacgtggggccgtgaccggaagtccttgggaaagatccgtcccattcccggaagctagagggcgttagttgtcgggttgaaaaggggtgtggggaggggaagcagctttaccccgggctcggagtttgcaggagagagaagtggggagcaagaagtgaacctcaggggctcacagggttcccgcagatgctcaggccggccaggaatgcatctctggctctctgttcccacggacgtcactgcctcagccagcctcccccagagcccgccagccgctaagccggggccacacctgggggtgatttcatgcctcacctccagtaggcaccttggtttctttgggctaatctctggctcccttgcgctaactcttgctctcacccagctaatccctgcctcaccctgactgccccaggggctgaccactaacaaccaacctggccctgtctgggggttccaggctcctggcctggccctgaccggttcttaattaacctttccttcaccttgactaactcctgccttcctggtctgttcctttcagcagaaactaatggtttgtggatttttttctgactaacaacaggtctaacattcctcgttactgttaacagcttggatgtcggcatggctgggaaggggctaacacagctttgaacttggctaacacaggtttgaacttggctaacacaggtttgaacttgactaacacagggaaaagcatagctaacaattttgggcgtggtggctgctctgagtcagaacaatcagaagtcggtaaagatggtagttttctaaaggaggtgccagggctctggtgtggaccaggcctgatggagcagtggtacccaccaaggtggggtcagaagtatagccagtcttgcaaggttttggccattgggcatatcttcactcctcatagtctgcatttggtttcagttcttaaaaaaatatagccttatagctacagtagtttgcacaagtagatgcagctcttataaaccttaaaatacctgtctggtgtctacagagcatatgccattttgtatagagtcacccttccccaggccagggcctagagtcttcattttggggactttgtgttttggaagttctaggacataaagctttagatcagagtattcagaagggttataactccgtcagtcatttacatgttagtagtataaattatctgagcttcctgttctaacttttagctcttctagcataaactcttctgtgcaatttagctgcaccgaggaaacgggagtttttctggaagggacttttgatctctttagactgagggaacgtcctttgggagtagaggggcagggagcatacgcaagggattccaggtgcaggtaaaaggtggcactagttcaaggttttgctgactcagtctggtagtcagagtctgcaggagaagacagttcaaggcagggcctggaggattggatcagtttagggacaggtcaaaggctggcttacagaccttagaggcaggttgcttgggtcgttgaatgctagtctggtgctgagagcccttttctctggcaactgtggactcagagctaaccaattgtagttggcagtgggggtgaagggtgatccagaggcctgagctgcagagggcacaagagagaaaagatgtcttagaaagagctttgagaacatgccttggctgctggcagggaccttggatggggtagtctacacccggaagtgcctgcctgccatcctctagtggctgccttgctccatttcactcaaagcaggaagctcacacctcctattcctgaaactcctctttgtttaactgcaaagacttgatgctgctaaggatctactatgtgccaggcactgctctgggcgctgggacctgcacctgggctttttcgtcatggtgcttttatagcctagtgggagagttggtgaagtagatagtgattcagtgagatgggtgttatgattggtcaggggtctgtgggagcaccaaggagacagacaagattgatgtgcacctactctgtgccaggcgtgtgccaggcattggggatgtagtggtagttaaacaccatttggtcttcaggagctttaattctagtgtgttgggtgcaggggggtggaatggggacagagagacacctaatccaccctgtggtggctttctggagagggaggcatctaagctgagctgtggctgggtggagtgtgggtggggatgagttccgggcagcgagagtggtggacaccagtttctggggatcagagaggatccaaagaggttctggaaggttcatgtggaatgtagcaagagataggagacatggacatggtgccgggtctggttgccaagaagtttagattttatccttaggccttggggagcgacggatatgatctgagaaagggagttagtggatttgagttttaggctggccatttggcttttccagcccaggtggaactcagaggagtttgcaatggcctctggccacattttagacaactgagcagaactttttgaaactaggaagaccctttggtccatcttttgataaacagaatccatacatgtctaccccagttggaagtatctctgcaatgactggaaagtaaagaggaccaaggtgaaaataaaggctcggaaggggagcaatcttgaaaacatgtcatcccatggtggtgggaagtccctggagaagatcaggggaaacacagtcataggctgcaagtctataagataattccattggggagggagcccatttgtcatgcatggctgcaaggggcagatacaagtgtggagtaagcttgcaagagctgatcctggtcccagagagggaaaaatatgccttggtgggtaatgaaccttttgttcccagaggcagaaggattgggactaggccaacatagagattggcgatggttgtgagattctaagagtgtgtgtgcatcttgacaatattagaggaggctgagcccaagcaggcacattctcttcgacccctccctcattcagtctgctttggagtctactgaacatcaagcttgctatgagcaggatcttagagctgaggaattggcctcccaatccgaacaggtgttataatcctttcttaataggttgtgctgtggacccaatgtgagggctgtgctggtgtaaatggtgacatgttgagctggggggatgctttcggggtggggggactggttccattccatcaaaggccctcttgagagtctatccagggacccattgttttactttaacagaccagaaaagatgtttgttttccatgtcattacccccaggggataccgaatgtgtgggtagaaatttctctgtagattaaaaatcagatttttacatggattcaacaaaggagcgtcacttggatttttgttttcatccatgaatgtagctgcttctgtgtaaaatgccattttgctattaaaaatcaattcacgctgg

SEQ ID NO: 12645 - DNA, 9943 bp, Homo sapiens
  ENST00000616213
gagggagggaggctgcggacgagtgcggggaggagtttgagatgggaggcgcttgcaggggctcccccagttctgcgctgtgagccggggcacaaagagccctctgcactagcgccgcaggaccgcggacccgagttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagtttcagcactttgtgatcatatttataaaccttggacagggctccttggccttagagttaagtgaagagttaacactgtgactttagatgcatttttctcagtgtaagtgtctgagctcatctccagttctggactcgtgcccccactcccgggtgctgacagcaagctctgaagatatgctgagagagctccctgactctcctgactcaggtctgccagttgatgaagacagcacagttgttaccaaaaacaaaacctggcagatggtcctaggtcaggattagtggtcattctctggtcttctccagactggtgacacagggtggtcttaaaagagtcctagtccagcctctggctccccgaatttcctctggtgcatggggcatcaggaaagggcaggggagaaggagggggagcagaaaaataactgaggctgggcagaagggtcccttccatttcccatccattgcttcaaacaatgggtgattaccgtgcaccttgagtgaatgtcaaggcaggaagggttccagggccacccagtgtggcaggagcagagctgggatcagaattctggattcctgactctccgttcagctgctattcagctatcaccaagctgctgagtttgtcctactttctcctgggtcacattctgctgttgttgggaaacagggagtgagtgaagggaacctgggaacccttctcccctcaccttttaaggatgttctggggtggaataaagagaggtggagggtggggtgcctgggcccagcctccctggctcctggtccttctttcttcagcagggagttctggcaaggcctgggcctggggagggggcctgggtgcagttttctcctgcggtgtggttggctcttttgtcttccaggatgggcctgtggggtctgtgtggggaaggaaggagctgggagcctgggctgcctgtgtgtcggctggatgctgccaggtggctccatctgggccgcatctccaggactcctggcctggacttctctttggacctcgggtgaccttggattctggccacagtgacttagcggtcagactccggtggttttctagcccgctgggtgactccctgaagatctcatcctcttcacacctgttgggatggagcctcccatggataggaactcttcctggttgatgctcagcagatgactgatctggctctggaggacagctccaggggtatgagggaggcctggcagcccactactccctcctcacctgctcgggccctgcctgctgggccctattgtctgggtctgggggccctttcctgccccatgtgaacttgattcctcctcgcgtttctgccggtgaccagacagagcctggcctgggccaagtccccactgaccacactttccccaaggctgggtctcaaaggaccctacaggatggggacaggaacaaggatgggagtcggggaggggctgtcaggcagagggcagatgcagctcctcgggtgccgctggctggagtcctttgtctccatttgctcagtgcgtaattgtcattttgtgggggacttccttggtggggcttttccatgcttttcctctccctgatggttacaaagaggagacagtcaggatctgggaggagctggagccttccccctgtgctgttgaactctgggaggggcagccagaggggctgagagtgcaccatcctgaaaagagagggtctttaagagataagatttaggctagggaaattcactagaaagagacaggtggccctgggttttttttcctgccatccaaagggaaccagtcttacccaaaggcttaaggggtcaccttagcccagtctcaggacactcttctccaatcagatcgctgcttctagttgcactgctcctggattctgttcttggggaacagaaggtggcaggacaggccccacaatctgcaattccagctccctccagaggagacagtcccagcgtttgcaagagagcagcttgtggcctcccttaggcaagtttaaaagccagatgtcctttttcccagaatgcggagtggtgtgtactattcatcagcttgggctgccacagcaccatgccagactggatggcttaaacatcaggaatttattttctgccagttctggaggctggaaagtccagatcaaggtgttaagacttggtttctggtgaggcctctctccttggcttgcaggtggcaccttctcactatgtcctcacatggccttttctctgtggagagggacagagagcatgagcaggctctggtgtctcctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaggaggagcagagaggtatgggaagcagacacggagagtggcaggtaccatgctggggtggctcaggagtgcttcggaggacatatggaactggcagggctcagtgcagggaggcggaggccctgggagagccgtgtcctgagaagggcctgggctacaaccctgggcaagttacttcacctctgagcctccgatgctctgtgaaatggaaggaatgtgcttgcctgtcaggtgcagggagaattcagtgagattgtgtgcctagcacagtgcctgactcccagtaggtgctcagcaaatgctcccatccatctgggagtatagacttagggtttatctatttttttttttttttggctctctggactttaaaactcagcatcttctgaaccagaggcatttctgattagcccttccctacctattttcctagtatcactctttaatcagcttggggaggtggcagcatttcatggcctccgtagtaactcacaatgcttcctggggtatttaaattctactctctcatcagcactgagcacctactttgggccctttcccgtgctagccatttgggggaaatataggtgaagagtggctggggtttgaacctttaggatttcacagccatgctggatgggataaaaccagctcacatggagaatcagagaatgggacagtgccacaaaacagtctactgaggcacaagttctgagtgcctgggaagtggtagagagaccccagagagggctgctgcagtctggaacagcttcctagcaagctgtaccaaacagggccttgaaggatgagaaagatctggctgagatgatacccgaccctctagggaaattcttaaagtaacttctaggaaatgtcattgctccttaaaaaaaaaaaaaaaaaaaaaaaagcaggttctaattcaaattccgctgcactactgaagtagtgcaggacttatcagaacctttaaaatgctaatggcaatttcaaatactcagggacagggcataggatgaagtgttccttgacttttatggccgtagaatctttttctcatggaacatcgtttagaactgtgggagatgctaggctggggtttctatgggaaaagtacagcagtgatagaagatggcataattagggtacacttaggtgctttgtagcattggctgaaaaggaagcagaccgggtgggcgtgggggagtctcaacttggttccaggagccaggccagcttgatgcgttttttttttttctaatggtgggagggcaggccaatagttggagaaactagaggcctgacagtcggtgatggaagagatgtctactaagcacggttgtcagatcttttgcggagagatgcgggtgtgcgtgtgtctgtcagagtgtaacaggatccagccctctgggaaggggctgaccagaaccaggcagggggtttctgtctaggacaagtagggtccattttcaggggagctgaaatatttgcagggggtgctctgagacccacagccaataaatagggaagcaacatgcttttgggcagggtccatgtggttagggttgattttgatggggctggggggcttagagttagaccccctgccctggtcaggccccactccctggctggtgggggcgggaggcctctgaagctgcagctggaggggccggggcagtgttgcatggtgtgattaacctactaacccagggctcagccgggacgctgtggcgtgtgacgaggtgcctggccttctgccaaccaactaacccactaaccaggcccgagcatgccctactaaccacccccccgcagccagatcctactaactgtgcagctcatgggcctttcaaggggctgggatatgggggcagccaaggctccagaaggctctgcctatgggctgggatctttgtgcagacccacgttccaggacagagaatgcaaataagactcaccaactctgccacttcctgttgagtgagtttgagtaagtcacctcacttctctcaacctcagtttcctcagtggtagaatgcgagttctgataccttacaggttgcagtgaggattcccgtcaatataagggtctcagcacatggcagacacctaaaaaaaaaaaaagtatgaggatggaggaaggcccctcaaacctggttgaacacgtctgctgcctaggccctggcctctctgggtgttctgcacacagatccttctgcctggggcaagacacttggctttgaatccatgtcacttccccacattcttcctccgtctcagctttcttttctgtaggcagctcttttgttcgattactaacccgtctaacccctggggtgcctcaactgcaccccgatcatcccttaacaaactaacggacctgcgtgcgttcttccttttctcttagcgactcctgtgtgtgtctgctgaggtgccctgtccgctggtgctgtgctctgacttactaacccagcccctactaaccctgttttctcttcttactaaccccagccctgccgagctctgggctccccccgggggctggtccccctccttttggcaagcagatgacctggggctactggccctgtagacagatgtcccactttgctgccccatattggctgtaagatcagagtccactgggccaggtctaaggcaggggatggccctattaacaagactcagaggaggaagaggtggtcctgtggatgtgggaggctggactctgagtatgacatctctcctatgtgcagaagtctggttgccactgggagtaggtgggaccagggaaatctctgggacgtgagtgtggaggcctgttggtctagactctagactgtggagctctgagcttttgtgtcctctggaaggaagctggggaagaatcctctccattgttaagtgacggggatagaagctgtcctgcacaggaagtcacgaggggggcgtatcccacgaggaaggcaggagggggcgtgcccctcaccggaaattagcagaggggcgtgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtaagtagacgtggggccgtgaccggaagtccttgggaaagatccgtcccattcccggaagctagagggcgttagttgtcgggttgaaaaggggtgtggggaggggaagcagctttaccccgggctcggagtttgcaggagagagaagtggggagcaagaagtgaacctcaggggctcacagggttcccgcagatgctcaggccggccaggaatgcatctctggctctctgttcccacggacgtcactgcctcagccagcctcccccagagcccgccagccgctaagccggggccacacctgggggtgatttcatgcctcacctccagtaggcaccttggtttctttgggctaatctctggctcccttgcgctaactcttgctctcacccagctaatccctgcctcaccctgactgccccaggggctgaccactaacaaccaacctggccctgtctgggggttccaggctcctggcctggccctgaccggttcttaattaacctttccttcaccttgactaactcctgccttcctggtctgttcctttcagcagaaactaatggtttgtggatttttttctgactaacaacaggtctaacattcctcgttactgttaacagcttggatgtcggcatggctgggaaggggctaacacagctttgaacttggctaacacaggtttgaacttggctaacacaggtttgaacttgactaacacagggaaaagcatagctaacaattttgggcgtggtggctgctctgagtcagaacaatcagaagtcggtaaagatggtagttttctaaaggaggtgccagggctctggtgtggaccaggcctgatggagcagtggtacccaccaaggtggggtcagaagtatagccagtcttgcaaggttttggccattgggcatatcttcactcctcatagtctgcatttggtttcagttcttaaaaaaatatagccttatagctacagtagtttgcacaagtagatgcagctcttataaaccttaaaatacctgtctggtgtctacagagcatatgccattttgtatagagtcacccttccccaggccagggcctagagtcttcattttggggactttgtgttttggaagttctaggacataaagctttagatcagagtattcagaagggttataactccgtcagtcatttacatgttagtagtataaattatctgagcttcctgttctaacttttagctcttctagcataaactcttctgtgcaatttagctgcaccgaggaaacgggagtttttctggaagggacttttgatctctttagactgagggaacgtcctttgggagtagaggggcagggagcatacgcaagggattccaggtgcaggtaaaaggtggcactagttcaaggttttgctgactcagtctggtagtcagagtctgcaggagaagacagttcaaggcagggcctggaggattggatcagtttagggacaggtcaaaggctggcttacagaccttagaggcaggttgcttgggtcgttgaatgctagtctggtgctgagagcccttttctctggcaactgtggactcagagctaaccaattgtagttggcagtgggggtgaagggtgatccagaggcctgagctgcagagggcacaagagagaaaagatgtcttagaaagagctttgagaacatgccttggctgctggcagggaccttggatggggtagtctacacccggaagtgcctgcctgccatcctctagtggctgccttgctccatttcactcaaagcaggaagctcacacctcctattcctgaaactcctctttgtttaactgcaaagacttgatgctgctaaggatctactatgtgccaggcactgctctgggcgctgggacctgcacctgggctttttcgtcatggtgcttttatagcctagtgggagagttggtgaagtagatagtgattcagtgagatgggtgttatgattggtcaggggtctgtgggagcaccaaggagacagacaagattgatgtgcacctactctgtgccaggcgtgtgccaggcattggggatgtagtggtagttaaacaccatttggtcttcaggagctttaattctagtgtgttgggtgcaggggggtggaatggggacagagagacacctaatccaccctgtggtggctttctggagagggaggcatctaagctgagctgtggctgggtggagtgtgggtggggatgagttccgggcagcgagagtggtggacaccagtttctggggatcagagaggatccaaagaggttctggaaggttcatgtggaatgtagcaagagataggagacatggacatggtgccgggtctggttgccaagaagtttagattttatccttaggccttggggagcgacggatatgatctgagaaagggagttagtggatttgagttttaggctggccatttggcttttccagcccaggtggaactcagaggagtttgcaatggcctctggccacattttagacaactgagcagaactttttgaaactaggaagaccctttggtccatcttttgataaacagaatccatacatgtctaccccagttggaagtatctctgcaatgactggaaagtaaagaggaccaaggtgaaaataaaggctcggaaggggagcaatcttgaaaacatgtcatcccatggtggtgggaagtccctggagaagatcaggggaaacacagtcataggctgcaagtctataagataattccattggggagggagcccatttgtcatgcatggctgcaaggggcagatacaagtgtggagtaagcttgcaagagctgatcctggtcccagagagggaaaaatatgccttggtgggtaatgaaccttttgttcccagaggcagaaggattgggactaggccaacatagagattggcgatggttgtgagattctaagagtgtgtgtgcatcttgacaatattagaggaggctgagcccaagcaggcacattctcttcgacccctccctcattcagtctgctttggagtctactgaacatcaagcttgctatgagcaggatcttagagctgaggaattggcctcccaatccgaacaggtgttataatcctttcttaataggttgtgctgtggacccaatgtgagggctgtgctggtgtaaatggtgacatgttgagctggggggatgctttcggggtggggggactggttccattccatcaaaggccctcttgagagtctatccagggacccattgttttactttaacagaccagaaaagatgtttgttttccatgtcattacccccaggggataccgaatgtgtgggtagaaatttctctgtagattaaaaatcagatttttacatggattcaacaaaggagcgtcacttggatttttgttttcatccatgaatgtagctgcttctgtgtaaaatgccattttgctattaaaaatcaattcacgctgg

SEQ ID NO: 12646 - DNA, 10143 bp, Homo sapiens
  ENST00000613780
gagggagggaggctgcggacgagtgcggggaggagtttgagatgggaggcgcttgcaggggctcccccagttctgcgctgtgagccggggcacaaagagccctctgcactagcgccgcaggaccgcggacccgagttggaggcatctgtccacccatgtggttccagacacgttcatgtggccaccatgaccccgtcggcatcacaggggtaaccaaggtccacagaacgaggggaaagggtcactgtggatcaagccaggctcctctgagcagtccagggtctatttacagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagtttcagcactttgtgatcatatttataaaccttggacagggctccttggccttagagttaagtgaagagttaacactgtgactttagatgcatttttctcagtgtaagtgtctgagctcatctccagttctggactcgtgcccccactcccgggtgctgacagcaagctctgaagatatgctgagagagctccctgactctcctgactcaggtctgccagttgatgaagacagcacagttgttaccaaaaacaaaacctggcagatggtcctaggtcaggattagtggtcattctctggtcttctccagactggtgacacagggtggtcttaaaagagtcctagtccagcctctggctccccgaatttcctctggtgcatggggcatcaggaaagggcaggggagaaggagggggagcagaaaaataactgaggctgggcagaagggtcccttccatttcccatccattgcttcaaacaatgggtgattaccgtgcaccttgagtgaatgtcaaggcaggaagggttccagggccacccagtgtggcaggagcagagctgggatcagaattctggattcctgactctccgttcagctgctattcagctatcaccaagctgctgagtttgtcctactttctcctgggtcacattctgctgttgttgggaaacagggagtgagtgaagggaacctgggaacccttctcccctcaccttttaaggatgttctggggtggaataaagagaggtggagggtggggtgcctgggcccagcctccctggctcctggtccttctttcttcagcagggagttctggcaaggcctgggcctggggagggggcctgggtgcagttttctcctgcggtgtggttggctcttttgtcttccaggatgggcctgtggggtctgtgtggggaaggaaggagctgggagcctgggctgcctgtgtgtcggctggatgctgccagcaccggcatggaccaagcaacttctctgagccagatgctggggacgcagaggtgaacccagagacatgatcccatctgctcagatcttcatgtcagaacacgctttattacagtctcggcaagggggtggctccatctgggccgcatctccaggactcctggcctggacttctctttggacctcgggtgaccttggattctggccacagtgacttagcggtcagactccggtggttttctagcccgctgggtgactccctgaagatctcatcctcttcacacctgttgggatggagcctcccatggataggaactcttcctggttgatgctcagcagatgactgatctggctctggaggacagctccaggggtatgagggaggcctggcagcccactactccctcctcacctgctcgggccctgcctgctgggccctattgtctgggtctgggggccctttcctgccccatgtgaacttgattcctcctcgcgtttctgccggtgaccagacagagcctggcctgggccaagtccccactgaccacactttccccaaggctgggtctcaaaggaccctacaggatggggacaggaacaaggatgggagtcggggaggggctgtcaggcagagggcagatgcagctcctcgggtgccgctggctggagtcctttgtctccatttgctcagtgcgtaattgtcattttgtgggggacttccttggtggggcttttccatgcttttcctctccctgatggttacaaagaggagacagtcaggatctgggaggagctggagccttccccctgtgctgttgaactctgggaggggcagccagaggggctgagagtgcaccatcctgaaaagagagggtctttaagagataagatttaggctagggaaattcactagaaagagacaggtggccctgggttttttttcctgccatccaaagggaaccagtcttacccaaaggcttaaggggtcaccttagcccagtctcaggacactcttctccaatcagatcgctgcttctagttgcactgctcctggattctgttcttggggaacagaaggtggcaggacaggccccacaatctgcaattccagctccctccagaggagacagtcccagcgtttgcaagagagcagcttgtggcctcccttaggcaagtttaaaagccagatgtcctttttcccagaatgcggagtggtgtgtactattcatcagcttgggctgccacagcaccatgccagactggatggcttaaacatcaggaatttattttctgccagttctggaggctggaaagtccagatcaaggtgttaagacttggtttctggtgaggcctctctccttggcttgcaggtggcaccttctcactatgtcctcacatggccttttctctgtggagagggacagagagcatgagcaggctctggtgtctcctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaggaggagcagagaggtatgggaagcagacacggagagtggcaggtaccatgctggggtggctcaggagtgcttcggaggacatatggaactggcagggctcagtgcagggaggcggaggccctgggagagccgtgtcctgagaagggcctgggctacaaccctgggcaagttacttcacctctgagcctccgatgctctgtgaaatggaaggaatgtgcttgcctgtcaggtgcagggagaattcagtgagattgtgtgcctagcacagtgcctgactcccagtaggtgctcagcaaatgctcccatccatctgggagtatagacttagggtttatctatttttttttttttttggctctctggactttaaaactcagcatcttctgaaccagaggcatttctgattagcccttccctacctattttcctagtatcactctttaatcagcttggggaggtggcagcatttcatggcctccgtagtaactcacaatgcttcctggggtatttaaattctactctctcatcagcactgagcacctactttgggccctttcccgtgctagccatttgggggaaatataggtgaagagtggctggggtttgaacctttaggatttcacagccatgctggatgggataaaaccagctcacatggagaatcagagaatgggacagtgccacaaaacagtctactgaggcacaagttctgagtgcctgggaagtggtagagagaccccagagagggctgctgcagtctggaacagcttcctagcaagctgtaccaaacagggccttgaaggatgagaaagatctggctgagatgatacccgaccctctagggaaattcttaaagtaacttctaggaaatgtcattgctccttaaaaaaaaaaaaaaaaaaaaaaaagcaggttctaattcaaattccgctgcactactgaagtagtgcaggacttatcagaacctttaaaatgctaatggcaatttcaaatactcagggacagggcataggatgaagtgttccttgacttttatggccgtagaatctttttctcatggaacatcgtttagaactgtgggagatgctaggctggggtttctatgggaaaagtacagcagtgatagaagatggcataattagggtacacttaggtgctttgtagcattggctgaaaaggaagcagaccgggtgggcgtgggggagtctcaacttggttccaggagccaggccagcttgatgcgttttttttttttctaatggtgggagggcaggccaatagttggagaaactagaggcctgacagtcggtgatggaagagatgtctactaagcacggttgtcagatcttttgcggagagatgcgggtgtgcgtgtgtctgtcagagtgtaacaggatccagccctctgggaaggggctgaccagaaccaggcagggggtttctgtctaggacaagtagggtccattttcaggggagctgaaatatttgcagggggtgctctgagacccacagccaataaatagggaagcaacatgcttttgggcagggtccatgtggttagggttgattttgatggggctggggggcttagagttagaccccctgccctggtcaggccccactccctggctggtgggggcgggaggcctctgaagctgcagctggaggggccggggcagtgttgcatggtgtgattaacctactaacccagggctcagccgggacgctgtggcgtgtgacgaggtgcctggccttctgccaaccaactaacccactaaccaggcccgagcatgccctactaaccacccccccgcagccagatcctactaactgtgcagctcatgggcctttcaaggggctgggatatgggggcagccaaggctccagaaggctctgcctatgggctgggatctttgtgcagacccacgttccaggacagagaatgcaaataagactcaccaactctgccacttcctgttgagtgagtttgagtaagtcacctcacttctctcaacctcagtttcctcagtggtagaatgcgagttctgataccttacaggttgcagtgaggattcccgtcaatataagggtctcagcacatggcagacacctaaaaaaaaaaaaagtatgaggatggaggaaggcccctcaaacctggttgaacacgtctgctgcctaggccctggcctctctgggtgttctgcacacagatccttctgcctggggcaagacacttggctttgaatccatgtcacttccccacattcttcctccgtctcagctttcttttctgtaggcagctcttttgttcgattactaacccgtctaacccctggggtgcctcaactgcaccccgatcatcccttaacaaactaacggacctgcgtgcgttcttccttttctcttagcgactcctgtgtgtgtctgctgaggtgccctgtccgctggtgctgtgctctgacttactaacccagcccctactaaccctgttttctcttcttactaaccccagccctgccgagctctgggctccccccgggggctggtccccctccttttggcaagcagatgacctggggctactggccctgtagacagatgtcccactttgctgccccatattggctgtaagatcagagtccactgggccaggtctaaggcaggggatggccctattaacaagactcagaggaggaagaggtggtcctgtggatgtgggaggctggactctgagtatgacatctctcctatgtgcagaagtctggttgccactgggagtaggtgggaccagggaaatctctgggacgtgagtgtggaggcctgttggtctagactctagactgtggagctctgagcttttgtgtcctctggaaggaagctggggaagaatcctctccattgttaagtgacggggatagaagctgtcctgcacaggaagtcacgaggggggcgtatcccacgaggaaggcaggagggggcgtgcccctcaccggaaattagcagaggggcgtgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtaagtagacgtggggccgtgaccggaagtccttgggaaagatccgtcccattcccggaagctagagggcgttagttgtcgggttgaaaaggggtgtggggaggggaagcagctttaccccgggctcggagtttgcaggagagagaagtggggagcaagaagtgaacctcaggggctcacagggttcccgcagatgctcaggccggccaggaatgcatctctggctctctgttcccacggacgtcactgcctcagccagcctcccccagagcccgccagccgctaagccggggccacacctgggggtgatttcatgcctcacctccagtaggcaccttggtttctttgggctaatctctggctcccttgcgctaactcttgctctcacccagctaatccctgcctcaccctgactgccccaggggctgaccactaacaaccaacctggccctgtctgggggttccaggctcctggcctggccctgaccggttcttaattaacctttccttcaccttgactaactcctgccttcctggtctgttcctttcagcagaaactaatggtttgtggatttttttctgactaacaacaggtctaacattcctcgttactgttaacagcttggatgtcggcatggctgggaaggggctaacacagctttgaacttggctaacacaggtttgaacttggctaacacaggtttgaacttgactaacacagggaaaagcatagctaacaattttgggcgtggtggctgctctgagtcagaacaatcagaagtcggtaaagatggtagttttctaaaggaggtgccagggctctggtgtggaccaggcctgatggagcagtggtacccaccaaggtggggtcagaagtatagccagtcttgcaaggttttggccattgggcatatcttcactcctcatagtctgcatttggtttcagttcttaaaaaaatatagccttatagctacagtagtttgcacaagtagatgcagctcttataaaccttaaaatacctgtctggtgtctacagagcatatgccattttgtatagagtcacccttccccaggccagggcctagagtcttcattttggggactttgtgttttggaagttctaggacataaagctttagatcagagtattcagaagggttataactccgtcagtcatttacatgttagtagtataaattatctgagcttcctgttctaacttttagctcttctagcataaactcttctgtgcaatttagctgcaccgaggaaacgggagtttttctggaagggacttttgatctctttagactgagggaacgtcctttgggagtagaggggcagggagcatacgcaagggattccaggtgcaggtaaaaggtggcactagttcaaggttttgctgactcagtctggtagtcagagtctgcaggagaagacagttcaaggcagggcctggaggattggatcagtttagggacaggtcaaaggctggcttacagaccttagaggcaggttgcttgggtcgttgaatgctagtctggtgctgagagcccttttctctggcaactgtggactcagagctaaccaattgtagttggcagtgggggtgaagggtgatccagaggcctgagctgcagagggcacaagagagaaaagatgtcttagaaagagctttgagaacatgccttggctgctggcagggaccttggatggggtagtctacacccggaagtgcctgcctgccatcctctagtggctgccttgctccatttcactcaaagcaggaagctcacacctcctattcctgaaactcctctttgtttaactgcaaagacttgatgctgctaaggatctactatgtgccaggcactgctctgggcgctgggacctgcacctgggctttttcgtcatggtgcttttatagcctagtgggagagttggtgaagtagatagtgattcagtgagatgggtgttatgattggtcaggggtctgtgggagcaccaaggagacagacaagattgatgtgcacctactctgtgccaggcgtgtgccaggcattggggatgtagtggtagttaaacaccatttggtcttcaggagctttaattctagtgtgttgggtgcaggggggtggaatggggacagagagacacctaatccaccctgtggtggctttctggagagggaggcatctaagctgagctgtggctgggtggagtgtgggtggggatgagttccgggcagcgagagtggtggacaccagtttctggggatcagagaggatccaaagaggttctggaaggttcatgtggaatgtagcaagagataggagacatggacatggtgccgggtctggttgccaagaagtttagattttatccttaggccttggggagcgacggatatgatctgagaaagggagttagtggatttgagttttaggctggccatttggcttttccagcccaggtggaactcagaggagtttgcaatggcctctggccacattttagacaactgagcagaactttttgaaactaggaagaccctttggtccatcttttgataaacagaatccatacatgtctaccccagttggaagtatctctgcaatgactggaaagtaaagaggaccaaggtgaaaataaaggctcggaaggggagcaatcttgaaaacatgtcatcccatggtggtgggaagtccctggagaagatcaggggaaacacagtcataggctgcaagtctataagataattccattggggagggagcccatttgtcatgcatggctgcaaggggcagatacaagtgtggagtaagcttgcaagagctgatcctggtcccagagagggaaaaatatgccttggtgggtaatgaaccttttgttcccagaggcagaaggattgggactaggccaacatagagattggcgatggttgtgagattctaagagtgtgtgtgcatcttgacaatattagaggaggctgagcccaagcaggcacattctcttcgacccctccctcattcagtctgctttggagtctactgaacatcaagcttgctatgagcaggatcttagagctgaggaattggcctcccaatccgaacaggtgttataatcctttcttaataggttgtgctgtggacccaatgtgagggctgtgctggtgtaaatggtgacatgttgagctggggggatgctttcggggtggggggactggttccattccatcaaaggccctcttgagagtctatccagggacccattgttttactttaacagaccagaaaagatgtttgttttccatgtcattacccccaggggataccgaatgtgtgggtagaaatttctctgtagattaaaaatcagatttttacatggattcaacaaaggagcgtcacttggatttttgttttcatccatgaatgtagctgcttctgtgtaaaatgccattttgctattaaaaatcaattcacgctgg

SEQ ID NO: 12647 - DNA, 590 bp, Homo sapiens
  ENST00000458302
agttctgcgctgtgagccggggcacaaagagccctctgcactagcgccgcaggaccgcggacccgaggtcctttctctggctgtgatccatgcttcttcccagggcaggattacactctttgaatttacttattcatcaagacagtgcagagtggtggaaagagaagcagctgagagttacgcagttggaggcatctgtccacccatgtggttccagacacgttcatgtggccaccatgaccccgtcggcatcacaggggtaaccaagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacatt

SEQ ID NO: 12648 - DNA, 574 bp, Homo sapiens
  ENST00000419237
gttctgcgctgtgagccggggcacaaagagccctctgcactagcgccgcaggaccgcggacccgagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagtttcagcactttgtgatcatatttataaaccttggacagggctccttggccttagagttaagtgaagag

SEQ ID NO: 12649 - DNA, 507 bp, Homo sapiens
  ENST00000449717
acaaagagccctctgcactagcgccgcaggaccgcggacccgagatgtccggcgtcaaatttggctccaaaaggatggagagggctggtaggtaacccaccctcgttgaaaacaacagtgacatcagtttatggagaggttactctacgcagggacgtgcttggtgctttgcaagcgttatcacaacagtcccacgaggtgttggaggcatctgtccacccatgtggttccagacacgttcatgtggccaccatgaccccgtcggcatcacaggggtaaccaaggtccacagaacgaggggaaagggtcactgtggatcaagccaggctcctctgagcagtccagggtctatttacagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgca

SEQ ID NO: 12650 - DNA, 572 bp, Homo sapiens
  ENST00000453023
aagagccctctgcactagcgccgcaggaccgcggacccgagttggaggcatctgtccacccatgtggttccagacacgttcatgtggccaccatgaccccgtcggcatcacaggggtaaccaaggtgatcctccctctcttcctgtgtccactggggatggtagagaccagcttaatgctttgagatcagatccatcacgaaatccgtatgtcctgagacctcctgaatcttaaggtccacagaacgaggggaaagggtcactgtggatcaagccaggctcctctgagcagtccagggtctatttacagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcc

SEQ ID NO: 12651 - DNA, 589 bp, Homo sapiens
  ENST00000532179
accaagactaatgaaggtccggccctccccagtgtaggaggcaggtaaatgatcacactgtgacaaatgctcaaacggggatgtgcttgcaaaggctagagacagcacgggaggaaggagcagtccattctgctgagagtgtgagtaccgagaaagcatggcactgggcttgaaggatgaggagttcgccagacacagaggatgaggagagcagcacgtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggct

SEQ ID NO: 12652 - DNA, 546 bp, Homo sapiens
  ENST00000526065
aatgaaggtccggccctccccagtgtaggaggcaggtaaatgatcacactgtgacaaatgctcaaacggggatgtgcttgcaaaggctagagacagcacgggaggaaggagcagtccattctgctgagagtgtagctcagttccaagaacacttattgatgcttacaccgggccaagccctgtgatgggccctgggttccagaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagg

SEQ ID NO: 12653 - DNA, 421 bp, Homo sapiens
  ENST00000532945
cagtccattctgctgagagtgtgagtaccgagaaagcatggcactgggcttgaaggatgaggagttcgccagacacagaggatgaggagagcagcactgtagtaaacttccagccacctgaatgaaattcacctaatttaacaaactgcacgagaagcaaagcaactcccggagcatacacagcaaacaacgttctaagaattttacatatattgacttatggaagcctgacaacatcactgtgatgtaagtgctattgttatttacattttatggatgaggacaaggaggcactgaacagcaaagtatttgccctggatcaccaggatttgggcaaaggtatgctctgagacctttttccccgccttatgcccattacaaggtaccttgaatgaaaaaatacacaagaacattgcatgga

SEQ ID NO: 12654 - DNA, 3906 bp, Homo sapiens
  ENST00000256194
ctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaa

SEQ ID NO: 12655 - DNA, 1089 bp, Homo sapiens
  ENST00000531732
cctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaagtacagtataattttctttttctgcctagaaagcagatactacaaaatagaaattccacttgctgcttccaaagggtgtttctgtaggagttattcttactgggagctggttggcataatgccactgaagggtattttactgttttttttttaccattgctatgactttaggtttgctgtttggctccaaggggatttatgattaagccattaaacctgtaatttggtta

SEQ ID NO: 12656 - DNA, 473 bp, Homo sapiens
  ENST00000530823
gaacaaactttctttgcaggattgggtcaaccatggggtctgatttggagatgcttcccttctctgtcagctgctcatgtctcaaatgaagagccttttgtgatgaccatgtatggaatagtgtctgaagtaccactgcactgtacctgtctttgcgtctaaacatcactaccatcatcacgggacaaaccgcccatctcagtggtgtctggcagtgagctgaacatggcaacccgtgtgtgtctcatcccagaaagagaagactttaaccactgtgatgcctgagaatccaagacagagtctcactgcgttgcccaggctggtcttgaactcttggactcaagcaatcctcccaccttggcctcccaaagagcaggaattacaggtgtgacgtttctccagatacttcatgctgttcacctgtgtcctcgccgcaccactgccgcacacgactcctgaaccatgggggaaaa

SEQ ID NO: 12657 - DNA, 516 bp, Homo sapiens
  ENST00000532420
aatgatgctgattctctcctctgcacagcctcacaatcacctgaatatccccttcaagtgcatcctgccctgggtttcctgtgtgcacattgagtttccttctctagttgaagagagagtttgcagaggctggcaaacctggagctggactgaatggcctggacaggtggagcaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaag

SEQ ID NO: 12658 - DNA, 3358 bp, Homo sapiens
  ENST00000527546
aggaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacacttttt

SEQ ID NO: 12659 - DNA, 573 bp, Homo sapiens
  ENST00000524685
ggtagatggtgtgcttccagctgataccaggagcagaagttttgagaagagactgtttgtcatgtggatagtggaaagccctgctctctggtaacgaatgaagaaaggctttaaagctgggtgtctacggagaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactcctt

SEQ ID NO: 12660 - DNA, 566 bp, Homo sapiens
  ENST00000525119
agatggtgtgcttccagctgataccaggagcagaagttttgagaagagactgtttgtcatgtggatagtggaaagccctgctctctggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatc

SEQ ID NO: 12661 - DNA, 593 bp, Homo sapiens
  ENST00000533389
ataggggaagagattacctgcaatgccacatcgacaggccaaaaggcacaattctgtatctgttataaatatttatgtttagtattgaacactaaatagtgtggttaatatttgaatgtcttaaagaaattgcatttttacttctcagcacccatcccccaccctaacctcatcgtccaaagctgacctctgcctccccctactttcacaggtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgc

SEQ ID NO: 12662 - DNA, 2868 bp, Homo sapiens
  ENST00000528931
atgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctga

SEQ ID NO: 12663 - DNA, 581 bp, Homo sapiens
  ENST00000532166
agacatgaaacgatgtgagctacgagtgagtgacatgatctgacttgaggaggactgctctggttgctgtatggggacagactgcaaagtgacaagggtggaagctgggagaccagataggagccctgatatcagttcaaaggagagatggccatgacttggataaggaggcagcgtgtgagccggtgaaaattgattggattctatatctgttctgaagatagtaaacaagatttattggtggattggttgtgagagatgcacaggcaacaacaaagatgggactgtgttgacctgttcactccatactttcagatctcaagtgaggtgttcgactctgctgctggcaggggtacaggggtggccctcacaccctgacttcggggaacctatgtgttaaatggggagatgccatgagacccaaccgctacccagagaggtacaagccctgaggattgtgcttagaacttctaaactaggcagcagtgtgaacgaacttctgaggccaaaaggcagaatgtctgcgaataaaactgtccctgaaaatccagaccctgcagctactggttacagttggtcat

SEQ ID NO: 12664 - DNA, 588 bp, Homo sapiens
  ENST00000527195
agacatgaaacgatgtgagctacgagtgagtgacatgatctgacttgaggaggactgctctggttgctgtatggggacagactgcaaagtgacaagggtggaagctgggagaccagataggagccctgatatcagttcaaaggagagatggccatgacttggataaggaggcagcgtgtgagccggtgaaaattgattggattctatatctgttctgaagatagtaaacaagatttattggtggattggttgtgagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaagtacagt

SEQ ID NO: 12665 - DNA, 6307 bp, Homo sapiens
  ENST00000530691
agacagatgtgggtccatgttctagctttgctctgtgtcgccttgagcaagtcatttaactttgttaagcctcaatttctcatctacagaatgagaataataacgattccaaagggccactgtaagagttagatgagaaaacacagagctcttggtgcataatcccgctcagtaatgatcattgttggtatactgctgtgctcaaaggtcactgagcggcagtgattatgtagcattctgcatataggtggtgttcaggtattgctgtgacagttcctctctccttcctgcctgacaggtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagcagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcaccgtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaa

SEQ ID NO: 12666 - DNA, 331 bp, Homo sapiens
  ENST00000524730
ggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgtacgtacctcttggctgcgatttcccgacttcgcgacctgggctggtgacatcagcaggtgtgaaggcagatg

SEQ ID NO: 12667 - DNA, 752 bp, Homo sapiens
  ENST00000533219
aggaactctgctggaagagaacatgcttcctctcccctcctgccacactcctgaccaggcccccaagcagcagtcctcagggagctgcacccgtgccagtggccccctgccctggccccttgccttggggccgctcgtcctggtccccagccatggtggcaatgagaagggagcgccagggcagaccgtgtgagattcctgcagagcctcactgcctgcgctctccttcttgcagagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtaagttttggcctggtttcggttttatttcccattgcacatggacggggtatgaggaacgg

SEQ ID NO: 12668 - DNA, 452 bp, Homo sapiens
  ENST00000529562
tcaagcaattctcctgcctcagtctcctgagtagctgggattacaggtgcccaccaccacacccggctaatttttgtatttttagtagagatagagttttgccatgttggccagcctggtctcgaactgagctcaagtgatctgcccgcctctgcctcccaaactgctgggattatagcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctc

SEQ ID NO: 12669 - DNA, 538 bp, Homo sapiens
  ENST00000526475
gaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcagaataaactactctctaaaggcctgtctcatactcatcctccatctcct

SEQ ID NO: 12670 - DNA, 575 bp, Homo sapiens
  ENST00000525075
ttgggctccaatcaagagtgtgggagcagtaaggaaggtggaaatcagaacaaagtcaagtccatggcgaatcagctgctggccaagtttgaggagagcactcggaacccctcactcatgaagcaggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggtaaccccaggggccagggcagcactgggctctggccttggcctcaggtgtgaccttggctcgggttcctgtccctctggtggctctaggacacccaaacatacccaaaaggaagtatgatgtcatcaggaaagctgctcagggagactgggagctcctgctagaaggggaggctgcctgtggtcccagggaaggggtagcatcagcactgtggtacggcataccaggtcctggtgggcacctgtgtgcccagggctctatg

SEQ ID NO: 12671 - DNA, 459 bp, Homo sapiens
  ENST00000525216
gggaaggaagcttaattttccctctttcccagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagagcatgaagagctctttatttttcaagccaccaaataatacaagctggcatctagaaaagacccaaatgcgaagattcaaaataaataaatacatcatgagaaagg

SEQ ID NO: 12672 - DNA, 536 bp, Homo sapiens
  ENST00000534563
acagctgggtgggacagaaaatttcgctaccctgccttctacccgcccgagggcgcaggctctttccggggtgctgtggcggctgcagcaagtggaggaaaagattctccaggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctca

SEQ ID NO: 12673 - DNA, 557 bp, Homo sapiens
  ENST00000525979
aagatactgaatgatgaggccaaccacatgctgcaactggggctctgcttccccatgggataaagtcaagccaacaagaatggctttgccttagaattaggaagtagagcctcctccaagccaggtacttatttggaaatttgctgaaaagaagagcatgtgctcaagaggaaatgaaagagttgataatgagatcctacaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatg

SEQ ID NO: 12674 - DNA, 566 bp, Homo sapiens
  ENST00000526672
gaggaagagatgggccagctcggtgcagtgtgaggaacgctctgatatctaggcggggaccatcattctgcgtggggtcacaggatcacttggaaaatgcctctttgtagaggtctagccatcgtctgcagcctctggcatgggtgcgtgtgacaacagctgcgtcgccgtgtttctatctagattggctctggggagaggaggcagggagctcgtcctgtgtgggccatgccactcttgtgcagaggaaagtgatttaagacaagagagaagtcccagaacatggaaatgcaaagctgcacaaacggccgtgctttgttttaatttttgtggctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgttt

SEQ ID NO: 12675 - DNA, 3982 bp, Homo sapiens
  ENST00000525618
ttgggcttcctaatcagaaagggagcaaggagctcctgggctttgtttgcaccagtctgccaggcactcctttccctgctcagccctatttagtgcctgtgctttcgctggaagccagtgagttagccttaggccctgaggatgggcactgctaccaggaataggggagctgtggtgagcccgtcatctgctttgcagttccctggactccctgctttatgtttgaggctttctcttatcagtttagatgtgacctcccaagggcagtcttgggttttgatggaagtcatcatttcacccacacacaagttactgttatttggtgtggtgatggatatcaacccctgcccagaggccctgcagcctccattgctgctctctctggccacatctcccagaggctgggttcagaagctggggaggacctagagcttccctcactctacgatcctgggatcaggagcagtgtttctagaatctcatgctatgtgtatttacctcccacaagaagagactgcagcgataccagggtgggcttccagagcaggcttccagagctgggggtgaggggtgaaggggagagcaagctggggtttgcagaagggggtatgtataattgtgccatgctctttgggctgtcagcttccaccccttccccagctctttgacaccttggtgggggtccaggcatttgtaggtaccctcaggagcacaggcacccacaacctgtcactgggccatgcaccccagggcccaggcagagctgccacctcgctgtctccaagccgaccttgcctggcgctagctctggagcctgctgcagtccccatcctgtcctacctgcccagtgtgcgcccattccacatactgctcttgttggcagggtgggctgtggtcctgctgggagggacctgggagcttcaaggcaggctagggcaggctgaatctagaggagggaagggagggaggaagcaaggtataagaaaaaaactgcttctctctactctcacaccactcacctctggtcaccaaataaagtggggatgtttctccccaccaacaaaatctataaatggaaaggttttccctgagttctacgagcgatccttgcaaattagttaaacccgaggagggaaacacggttactggtttattatacaggatcttatcaaggatagggaggaacagccaggtgaggagaggcacagggcagggcatgtgggaaagggtgggcacctctctgccgtctctggggcactgcccttcaggggcctctgcatggtccaccctccagaagctccaaaccctaaccttttcggtttctatggaggcttcgttatgaagggcatgatcgattacatcactggctgttggtgattaactcaaccttcagcctctccgcccttgtaggtcagtgtgtgggactgaaagttccaaccctttaatcacagggttggttcccctggcaaccagccccatcctgaagctatccaggagctcaagagtcacctcgttccagcaaaggatgctcctatcacccaggaaatcccaggggctttaggatctctgcatcagatgctgctgtcactcagaaaggtacaaaggtcttaggagctctgcctcaggaaccagggggcagagtccaaatatgtatttccgaccatatcacaatatcacacaaggtagtcctggcccagagcctgccaagtgccaggcaataggacacacattctctcgtgcagtccttcccacaaactcgggagacaggtataactctccccattttactaaatgaggaactgagctcagaagttctgtgctttacgccaagtctcagcactggcccatggtggagctgggcccatacccttcccctggtcttcctggtccctgagcagctgcctgcagccctccggggacaaggggtctctggaagagggtggccgcagtctggcagtctacctttctgtctgagggggcttggttcctgattttcttctcctctttgcttggcttgtctaactcgcaggtttttggggcttttgggtaatgattgggtctgagtaccacgtttaccccatgcccctgctgagtgaagctgtgaatgccccagggctggggggcaggagaccagagtacagtctggaatcttgaatttatttgctaagcggcctcagatagaccgttcccttctctgggattcatgtacatatctgtgcaatgagaggctcaggaactttggaaggccttgcaccccacggtgaatgtaacagtcccatggcccacccaggactaaaaggcttttggtttttaatcttttttttcctcgaatttttttattgtgttaaaacatacatgacgtaaaatttaccaccttaacttttttttttttttttttttttttgagacagtgttttactcttgttgctcaggctggagtacaatggtacgatctcagctcactgcaacctctgcctcccaggttcaagtgattctccagcctcagcctcccaagtagctgagattacaggcatgcaccaccatgcctggctaattttgtgtttttagtagagacgtggtttctctatgttggtcaggctggtcttgaactccggacctcaggtgatccacccatctcggcctcccaaagtactgggattacaggcgtgagccaccacacccggccagccttaaccattttttaagggtacggtttagtggtattaaatacatccttcgtgtgcaaccctcaccatcctcccactccagaactcttagttgttgtaaaactggaactctgtacccactaaacaacagcaaccactgttctactgcctgtctctacgattttgactactctaggtaccacatataagtggaatcctagagtacttgtgtttttgcggccacagggttttatttattttcttttctccacctccagaatccccgcgttctgctcctggctggttttgcttctcctgggtcgtggggtgctatttgcatgtgggtgaggagccctctccccatccatcctgcttgtgttttcctcctgggtgctaactggcctctacctttgtctctgtctcctctgcctctgctcttggttagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagc

SEQ ID NO: 12676 - DNA, 5233 bp, Homo sapiens
  ENST00000530021
ctcaggagcacaggcacccacaacctgtcactgggccatgcaccccagggcccaggcagagctgccacctcgctgtctccaagccgaccttgcctggcgctagctctggagcctgctgcagtccccatcctgtcctacctgcccagtgtgcgcccattccacatactgctcttgttggcagggtgggctgtggtcctgctgggagggacctgggagcttcaaggcaggctagggcaggctgaatctagaggagggaagggagggaggaagcaaggtataagaaaaaaactgcttctctctactctcacaccactcacctctggtcaccaaataaagtggggatgtttctccccaccaacaaaatctataaatggaaaggttttccctgagttctacgagcgatccttgcaaattagttaaacccgaggagggaaacacggttactggtttattatacaggatcttatcaaggatagggaggaacagccaggtgaggagaggcacagggcagggcatgtgggaaagggtgggcacctctctgccgtctctggggcactgcccttcaggggcctctgcatggtccaccctccagaagctccaaaccctaaccttttcggtttctatggaggcttcgttatgaagggcatgatcgattacatcactggctgttggtgattaactcaaccttcagcctctccgcccttgtaggtcagtgtgtgggactgaaagttccaaccctttaatcacagggttggttcccctggcaaccagccccatcctgaagctatccaggagctcaagagtcacctcgttccagcaaaggatgctcctatcacccaggaaatcccaggggctttaggatctctgcatcagatgctgctgtcactcagaaaggtacaaaggtcttaggagctctgcctcaggaaccagggggcagagtccaaatatgtatttccgaccatatcacaatatcacacaaggtagtcctggcccagagcctgccaagtgccaggcaataggacacacattctctcgtgcagtccttcccacaaactcgggagacaggtataactctccccattttactaaatgaggaactgagctcagaagttctgtgctttacgccaagtctcagcactggcccatggtggagctgggcccatacccttcccctggtcttcctggtccctgagcagctgcctgcagccctccggggacaaggggtctctggaagagggtggccgcagtctggcagtctacctttctgtctgagggggcttggttcctgattttcttctcctctttgcttggcttgtctaactcgcaggtttttggggcttttgggtaatgattgggtctgagtaccacgtttaccccatgcccctgctgagtgaagctgtgaatgccccagggctggggggcaggagaccagagtacagtctggaatcttgaatttatttgctaagcggcctcagatagaccgttcccttctctgggattcatgtacatatctgtgcaatgagaggctcaggaactttggaaggccttgcaccccacggtgaatgtaacagtcccatggcccacccaggactaaaaggcttttggtttttaatcttttttttcctcgaatttttttattgtgttaaaacatacatgacgtaaaatttaccaccttaacttttttttttttttttttttttttgagacagtgttttactcttgttgctcaggctggagtacaatggtacgatctcagctcactgcaacctctgcctcccaggttcaagtgattctccagcctcagcctcccaagtagctgagattacaggcatgcaccaccatgcctggctaattttgtgtttttagtagagacgtggtttctctatgttggtcaggctggtcttgaactccggacctcaggtgatccacccatctcggcctcccaaagtactgggattacaggcgtgagccaccacacccggccagccttaaccattttttaagggtacggtttagtggtattaaatacatccttcgtgtgcaaccctcaccatcctcccactccagaactcttagttgttgtaaaactggaactctgtacccactaaacaacagcaaccactgttctactgcctgtctctacgattttgactactctaggtaccacatataagtggaatcctagagtacttgtgtttttgcggccacagggttttatttattttcttttctccacctccagaatccccgcgttctgctcctggctggttttgcttctcctgggtcgtggggtgctatttgcatgtgggtgaggagccctctccccatccatcctgcttgtgttttcctcctgggtgctaactggcctctacctttgtctctgtctcctctgcctctgctcttggttagctgacggtagggaaagtgtccagcggaataggggctgcagctgaagtcctggtcaatctgtacatgaatgatcacagacctaaggcccaggccacctctccagacctggtaaggacatgcacccccagccttcacccacagacactggctctggcatcccagggcgggcacatgggatgtcgagaggatgccctggccctcccgaggctcctcttctcttggaacaagagggggctgagaatgagctgaatcagggcagaagttaaaaggagcctgcttttccttaaagacagatctcactcaggtcccctgtggtctttttgaaaatagagatcttcctgctctctgtggctttggagaacggcctggtagaaaggcccaggtgaggccgtgagcataattgaatggccctcactttcagtgtttagtgtccaacctgaacagactctgtgcattggattgagaaaaaggtcatggggaaaatagccctttgatttgaattctccctttctctaaactgggctgctcgctgccatcaccaggaattttagttgaccattctttctgtttccttttggcccattgccctggaatcgcccaggggtactgctgccctggcccgtgccctcccaattcacaactaggactataactgaccagatttgatgccacaagctttcctcacccaacctgtgccactgcaggggaacaggacacctaaaacatcctcagcgggccagtttcaggacctttgtccagaaccaggtgacacttaatcccaaggacagatcctggaaagaatatcctggggtggacagggttgtgagtaaagcccactccgtcagaccaggatcactcccaccccaaaaccagagcagccaacctcggggagagcccctcccgggcccaccttgttgtctcgggcctgtctgggagtacagttaacagaagcccctgcagggttggggtctgggttgggggtgtatcttcctacccctccctctttgctgcagtggcagtagcaggaagcagaagcccacgaggtccccagcattcagtgtggaatttctaaaagccttggcctggcatttgaaggctcgggataagccataatacacccactcttctctcccgatccccaggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcaccgtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttat

SEQ ID NO: 12677 - DNA, 435 bp, Homo sapiens
  ENST00000526604
tgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtacccagatgccacttgtcagcagcaggatactttttacaacacgaaagcataattattttagaagaagagagtagaagggcagaatagaattcaacttacagaagcacgga

SEQ ID NO: 12678 - DNA, 489 bp, Homo sapiens
  ENST00000525444
tggttgcagggtctggcgagttcagtttgtattggctgttggctttgttgaagtagtcctctggaagacttacagacaaatgccctcatttccatctctttctcaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttcttta

SEQ ID NO: 12679 - DNA, 6625 bp, Homo sapiens
  ENST00000379612
gtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaaaagaagtcaccttcagggttccattttcatcccagccatttgagaacagtgcatcctcaggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagcagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcaccgtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagctc

SEQ ID NO: 12680 - DNA, 3711 bp, Homo sapiens
  ENST00000342902
gaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagctc

SEQ ID NO: 12681 - DNA, 3774 bp, Homo sapiens
  ENST00000537344
gaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagctc

SEQ ID NO: 12682 - DNA, 482 bp, Homo sapiens
  ENST00000529028
gacctcagtgaggatcagccctggggaggaagcagctggacaggatgtgctggctgtgcgtgtcctggtcaccagcgaagacagcagctctgacacagagtctgactatggtggcagcgagggctcccacacagaaccctgtgaagagaaaccctggcggccaggatccccgcatctaccgcacacgtccctaggggaggccctgagcagggcagtctctccacagtgccctgaggagcccagagctgtgcacgcagctctgcaacgggccaatagcttccagtctccaaccccaagcaaataccagaactggaggagagaattctggtggagtgagtcactagctctctgggggtgggaggctggggctgggcagaagatctctggttaattctcaggggcagccgttctcattccttacatggtatctctctggcatggcctcctggttgtcagaggcaagaaataaaatataagcttga

SEQ ID NO: 12683 - DNA, 343 bp, Homo sapiens
  ENST00000533534
gtctgactatggtggcagcgagggctcccacacagaaccctgtgaagagaaaccctggcggccaggatccccgcatctaccgcacacgtccctaggggaggccctgagcagggcagtctctccacagtgccctgaggagcccagagctgtgcacgctctgcaacgggccaatagcttccagtctccaaccccaagcaaataccagaactggaggagagaattctggtggagtttgacgccagtgaacaaaagaactatgtcacctcctaaggacccttctccttctcttcctcttccttcatcgtcttcccattcatcttccccaccatcttcttcttcaacc

SEQ ID NO: 12684 - DNA, 3044 bp, Homo sapiens
  ENST00000256186
aagtttggtagagtgtgttgtggggacagcagtatggtgtgagggaaggagagagttcagtctattataatcattagtctattgacttgtggtaattgagctataggagataaattcctacttactctacacatttaatggactcttcctcccaccccatcttccctgtccctttctttttccacagcagctctgcaacgggccaatagcttccagtctccaaccccaagcaaataccagaactggaggagagaattctggtggagtttgacgccagtgaacaaaagaactatgtcacctcctaaggacccttctccttctcttcctcttccttcatcgtcttcccattcatcttccccaccatcttcttcttcaaccagtgtttctgggaatgctccagatggttcctccccgcctcagatgacagcttctgagcccctctcgcaagtctcgagaggtcatccaagtcctcccaccccaaactttcggaggcgagccgtagcccaaggagcacccagggaaattcccctgtatctgcctcatcacccaaagccagagtgggcagagtactgcctggtgagccctggtgaagatggcctctcagaccctgcagagatgacttctgatgagtgccagccagcagaggcccctcttggggacatcggaagcaaccacagagacccacaccccatctgggggaaggacaggagctggacagggcaagagctatctcccttggctggagaagaccgggaaaaagggagtactggagccaggaaggaagaagagggagggccagtgctggtaaaggagaagttgggcctgaagaagttagtcctcactcaggagcagaagaccatgttgttggattggaatgactccatccctgagagtgtgcacctcaaagctggggagcgaatttcccagaaaagtgctgagaatggtagaggaggccgtgtgctaaaaccagtccgccccctgctgctccctagggcagcaggagagcccctgccaacccagagaggggcccaggagaagatggggacccctgcggaacaagctcaaggggagcgaaacgtgcctccacccaagtccccactgcggctcatagccaatgccatccgaaggtctctagagcccctcctttccaactctgaaggcgggaagaaggcctgggccaagcaagaatccaaaactttgcccgcacaggcctgcactcgctcattcagccttcggaaaaccaattccaataaagacggggaccagcattcccctgggagaaaccagtcctcagcctttagccctcctgaccctgccctccgcacccacagtttgcccaatcggccatccaaggtctttcctgcacttaggtccccaccctgcagcaagattgaagatgtccccacactcctcgagaaagtgagtttgcaagagaacttcccagatgcttctaagcctccaaagaaaagaatctcacttttttcctccctcagactcaaagacaaatcttttgagagtttcctccaagaatccagacaaagaaaggacatcagggacctctttggcagccccaagaggaaggtgctgcctgaagatagtgcgcaggccctggagaagctgctgcagcctttcaaaagcacctccctgcgccaggcagctcctcctcctcctcctcctcctcctcctcctcctcctcctcctacagcgggaggtgcagactccaagaactttcccctcagagcacaggtaacagaggcttcctcttctgcctcttcaacctcctcctcctctgcagatgaagaatttgatccccagctttccttgcagttaaaggagaagaagacacttagaagaagaaagaagctagaaaaagcaatgaagcagttggttaagcaagaagaattgaaaagactctataaggctcaggccatccagaggcagctggaggaggtggaggagcggcagagggcttctgagatccagggtgtgaggctggagaaggcgttgcgaggagaagcagattcaggcacacaggatgaagcacagcttttgcaggaatggtttaagctggttctggagaagaataaattaatgcgatatgagtcggagctcctaatcatggcccaggaactggaattagaagatcatcaaagcagactggagcagaaactgagagagaaaatgctcaaggaggagagccagaaagatgagaaggatctaaacgaagagcaagaagtattcaccgagctgatgcaagtgattgagcaaagggacaaactcgtcgattccttagaggaacaacgcatcagagaaaaagccgaggaccagcactttgaaagcttcgtattctccagaggctgtcagctgagcaggacttgaggaggcccgtagtccctctccctggctgcacgttgggaccggatcaggccaagtgcaccacacaccctcatgggtctttctgcaggatttatcatccctggaacttgttataccttactgcattttttaaaattaaaattctcttgcacgcatggcagcttcccaaggttcttccagagattcaaatgaagaaaacccaaagactctttggcaattggcagtcaacttcagccaggctctcagactggaggtgttgttggcagatgaccagcattgttttccctagaaagtgacacaaagacttgactttcctgctacttttatcattttccttcccaattcattgagttacatactttaagatttttgagaagctgccttttcattaatatatccatatttgccttttttgtatggatgaccagtttccaaatgtcagaaagaagcagccgcagtttaaagattaggttaatatttaaattgtgtttccagagaaagaggagaaaccttgagattactgattacataaagcaaataactcatatagcaggtgttaattcaatccagggtgaatttaatttaccaggtgcatttataagccttaatataatatacataagcaatgagagcttaatagaacatttgagccttaattttattttaag

SEQ ID NO: 12685 - DNA, 6044 bp, Homo sapiens
  ENST00000380779
gaccgattttcctgttgtgtttcactgttgacgcactcacagacacacaggaccgctccagcactgcctgccacccaccgtctggtctcggtggcctgtctatcatttcgtgggtccccatcctctgcctacggcgatgtttcttcaaaaagaactagtgtgcagtccattgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 12686 - DNA, 6195 bp, Homo sapiens
  ENST00000380780
ccctttcttctttatctcggtgtctgaggagttttgtctgcggcttgtcttgctacatttcttggttccctgaccaggaagcgaggtgattaacagacggttgaggcagctccttaggtggctttagcctgccctgtggaacatccctgcgggggactccaaccagccggagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 12687 - DNA, 6092 bp, Homo sapiens
  ENST00000380785
cccagcctgcttgaaggacctacaggtttgtctcttccagatcagaactgaggaacaaaaacccccatcctgggaaaaatggggaagctgatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 12688 - DNA, 5973 bp, Homo sapiens
  ENST00000380787
acttgccccagcccagcctgcttgaaggacctacaggtttgtctcttccagatcagaactgaggaacaaaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 12689 - DNA, 3352 bp, Homo sapiens
  ENST00000380782
atttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaatt

SEQ ID NO: 12690 - DNA, 858 bp, Homo sapiens
  ENST00000479925
ggagcacctgcaaagttatttgggcctggatatacagggcagggagaattttggaggcaaaaatgcaatctgccacatctacgttagtgaagtcagtttttcgtacatgactaccaagacaaagcacttcacttaccaactctattcaaataaatggaaattattcaacctaaaattatgcaaacattgctccccttgtgccaaagaactgcaccatgtctgattggctttgcaggtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcct

SEQ ID NO: 12691 - DNA, 1729 bp, Homo sapiens
  ENST00000413894
ctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagcc

SEQ ID NO: 12692 - DNA, 945 bp, Homo sapiens
  ENST00000423614
gagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtg

SEQ ID NO: 12693 - DNA, 6393 bp, Homo sapiens
  ENST00000453318
gattctatgcagggtcactatgaaagaggcagcctgccccagtttgggtattctgaagtgttagtatgtagtggagctggtggtgtgaagctgattcattttgtttcaaagccccaaatggcatgctgccgaacacaggcacaagcacagcagcgtctccttagaaataatgactccaaggcaaacagccctcattgcaaaatgtagaagactgccatctgcttgtctccactgtggtttattcgtttcagggttttaaatgacgtaataaaaagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaccctctgtctctgcctgtctctgttgccttttcatcattttgtgtttttgcagttatgatgttgacaaatatttattcaacatctaccatttattcatactactttatgacatataattcattttcttttactgtctctcatccactatttgcctttccctattcaaaatacaattcttttgcaacactcaaaatattctccagggaatttttaaaacacaataaaagaaagcctatatagaagtg

SEQ ID NO: 12694 - DNA, 1839 bp, Homo sapiens
  ENST00000610939
atagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaagcaaaacttagagagtaacctcaccaaccttattaagaggaacacagaactggagacccttttggctaaactcatccaaacctgtcaacatgttgaactggaatgttctgtactgtttcccagagttgcccaatggggttaatctccagttgcccaaggtggtcttggtaagtcacactttactggcttcgtagttgtccctgtttcacttcctacccagtactggtgttttctggcaacaatttgaccatccattcttgtctcatatccttcttggggaggatacaactgccaaccatgtctaaaatgaaatgatagcacaagtctctttttctagtcatggctatagctcacatgttcaatttctctaaactcaagtctctttcattgtgtttgaataaacgtacatgtgaatcactggacatcaaagatatttaaaaatcaatctactcacttctcctgatattctagaatgacaacaacagggcaagatatttcatagatatcacttgtgggtgcgtcatgaaggcagaacaaagcttaacattttccagttgtacctcccagttaagttctatcagtgacgtaatcacgtgtatttcactcactgtacggaataccaaagagcagaaacccaatgttcattttccagaactttgcagaagcagatggcttctatacctgagtaactgaaacccaaaaaggggtccaactcagtatttttccagtacatcacttttcaggaatcatggcacaacaactaaaaggaatgtcacttaatgagaaataacatgtaagattgaaagtgattaaggtaaagtcatagagtagaggtttcctctttccattagaaataacttcccttcccttaaacacgtcacctccatctttcctggcactccattaatggtcatctgctaaaagttattgtttaccctctgaccacaacatcaaatgccaaacacatttgttgaaaattatttaatagaaatcgctacttttcagaaactttatgaaaaagacgtgatagagacaaacacccatggcaggttaagtagatttcttttcattcagtgtgcccagcccaaacggaagggtgtgaagcatttgttttataaagtgtgtaattaataagagaaaggaagggaggagtttattgtttttcaatgaattatgagcaaccccttccattctgcttcttcattttggaactgcttctaacaaagttaccattaaac

SEQ ID NO: 12695 - DNA, 1926 bp, Homo sapiens
  ENST00000616003
atagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaaactgtaaaggatcagaaagtcattggcagagagaagcagcagtattaccctaggaataggagaaagtgggtcagcaactccctacaggcaagactgatggggagaagatgcatttcaagacgcgaaagaaaactgactctagatgtagagaaggtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctcta

SEQ ID NO: 12696 - DNA, 6463 bp, Homo sapiens
  ENST00000317552
gattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaagaccctctgtctctgcctgtctctgttgccttttcatcattttgtgtttttgcagttatgatgttgacaaatatttattcaacatctaccatttattcatactactttatgacatataattcattttcttttactgtctctcatccactatttgcctttccctattcaaaatacaattcttttgcaacactcaaaatattctccagggaatttttaaaacacaataaaagaaagcctatatagaagtg

SEQ ID NO: 12697 - DNA, 758 bp, Homo sapiens
  ENST00000451923
cttcaagatgacagggcgctggagaaaaggctgctggaatcagctggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaact

SEQ ID NO: 12698 - DNA, 2876 bp, Homo sapiens
  ENST00000262843
gagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaagcaaactctggagatgaacctcaccaacctggttaagcgcaacagcgaactagaaaatcaaatggccaaactaatacagatctgccagcaggttgaggtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagtaagtcatggtgtagttggggcctgtggccagagataaggaaatgtaaggaagcagtaagctgctcaagattggccggggcgccacgaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataa

SEQ ID NO: 12699 - DNA, 2251 bp, Homo sapiens
  ENST00000443968
acctgggaacgctatgggtgaaagcccagcctccgtggttcttaatgcctcaggaggactattttcactaaagatggaaacactggagtctgaattgacctgtccaatctgcctagagttgtttgaagacccccttctgctcccttgtgctcacagcctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaagcaaactctggagatgaacctcaccaacctggttaagcgcaacagcgaactagaaaatcaaatggccaaactaatacagatctgccagcaggttgaggtgaatactgctatgcatgaggcaaaacttatggaagaatgtgacgagttggtagagatcatccagcagaggaagcaaatgatcgctgtcaaaatcaaagagacaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagagggtcgctatggcaactgcatcttctcaagttctgattccagacatcaattttaatgatgcctttgaaaactttgctttagatttttccagagaaaagaaactgctagaggggttagattatttaacagccccaaacccaccatctatccgagaagaactctgtactgcctcccatgacaccattacagtccactggatctcggatgatgagttcagcatcagctcctatgagcttcagtacaccatattcactggccaggctaacttcatcagcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtatgcaattggcattgcctacaaatcagctccaaagaatgaatggattggcaagaatgcctcctcatgggtcttctctcgctgcaatagtaacttcgtggtgagacacaacaacaaggaaatgctggtggatgtgcccccacacctgaagcgtctgggtgtcctcctggattatgacaacaatatgctgtctttctatgacccagctaactctctccatcttcatacttttgatgtgaccttcattcttccagtttgtccaacatttacaatctggaacaaatccctaatgatcctgtctggcttgcctgccccagattttattgattaccctgagcggcaggaatgcaactgcaggcctcaagaatccccttatgtttctgggatgaaaacctgtcattaagtttcaggagagtatataattcactggctctctagttcagcagttcttcccctcctacacctaagttagcgttcaatatacgagacacaaaataaagtttgtttgaagcatccaaaataa

SEQ ID NO: 12700 - DNA, 689 bp, Homo sapiens
  ENST00000474517
acagccccaaacccaccatctatccgagaagaactctgtactgcctcccatgacaccattacagtccactggatctcggatgatgagttcagcatcagctcctatgagcttcagtacaccatattcactggccaggctaacttcatcagcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagccaaccctttaaattggatcccaaaatgactcacaagaagttgaagatctccaatgatggattgcagatggagaaggatgaaagctctctaaagaagagccacaccccagagaggtttagtggcacagggtgctatggggcagcaggaaatatattcattgacagtggctgccactattgggaggtggtcatgggttcctcaacatggtgagtggatcccattttccttttcttttctgtcctctgtcattaggttcctaggagattcaattctatagcacaaccataataccaataagtcaaggttaaaaggtatgtgatgaaaaccactcctagaaaaatttgccagctttttaataaaataatggaaaatatact

SEQ ID NO: 12701 - DNA, 1163 bp, Homo sapiens
  ENST00000586757
gataaaggctgagggccgcgcgcttggcccagaccggcccggccagcgcgcattcggccccggacgaaggtactcgcagcacttggagcgcagaaccggccgcgcccgatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatc

SEQ ID NO: 12702 - DNA, 3243 bp, Homo sapiens
  ENST00000591446
agatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatcacagccggctccttccggtcccacgcagcctccaccacctgcccggagcagatggactgctcccccacggccagcagcagtgccagtcctggtgccagcaccacgtctaccccaggggccagccctgccccccgctcccgaaaacccggcgccgtcatcgagagctttgtgaatcacgccccgggggtcttctcagggaccttctctggcacgctacaccccaactgccaagacagcagcgggcggccgcggcgtgacatcggcaccatcctgcagatcctgaacgacctcctgagcgccacccggcactaccagggcatgcccccttcgctggcccagctccgctgccacgcccagtgctccccggcctcaccggcccccgacctggcccccagaactacctcctgcgagaagctcacggctgccccctcagcctccctgctgcagggccagagccagatccgcatgtgcaagcccccgggggaccggcttcggcagacagaaaaccgcgccacgcgctgcaaggtggaacggctgcagctgcttctgcagcagaaacggctccgtagaaaggcccggcgggacgcgcggggtccgtaccactggtcacccagccgcaaggccggccgcagcgacagcagtagcagcgggggcggcggcagccccagcgaggcctccggcttgggcctcgacttcgaggactccgtgtggaagccagaagtcaaccctgacatcaagtcagagttcgtggtggcttaggatcttcggatcggccaccctcgcccctcgcaccccagcccagggcggcggggactccgagagccccggagagaacgtggcccagccctggagggcaggcggccactcccccagccagaagtctttttttcttttcttcttttttattatttttttctttttttaaaaagttctgaccgtggtttcctggactcttcatgggctttgcttcctacctccttcacccttcactcctgccctcctcttcctcctcctcctcctcctccgtctgtctcctttcacctctgcgccaggtcggtcctccctgccaaccttccccagctccaatatgtagcagtctctctggatggcggagagtgaaggagacggagaaacgcgccccatcccttccgccgcctcctttcccccccgaccctattcaggttttaagtcaaaaatgtcgatatgtcattatgcactttacagatgaggggaggggccgcagtgcgcagaacccaccccaccccccagtgcagacttcggggtctccaccccaggccagcagcgcccactgggctacagcaagccaacaggtcacagaagccaacgaggggactgtttctcttccactcctatcctcttttcttgatcttttttttgcattttccttcatttctttaacaaggagagcaaagctgttttagcagaggctggggctgaggtccccatggggtttgggtgcaggggcatggcaccctttcctgtcgggaagggagaggggaactacccccccagcctgccctccgccccgccccagccggcggactgtgctgtttcctccgcccccactcccgtgttttctgacctcctgcctgagtttggggtatttatagactattaattttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgta

SEQ ID NO: 12703 - DNA, 523 bp, Homo sapiens
  ENST00000591302
atagagcacactggggcccagaggaggagaaagtgcctggttggggtgcagagggggtgccagagtccagggcgggggttccactggagggaaggggtccgaatcgccaggatggggctcccagcaccagacggagacctctctgcacgcgcttagggccctggatctggaagccgggaaggggtgggggtgggaacttatccgtctctccccacacaagcacagccctcccccgcggcctctgcttccgcgtccctgtgtcgtctccgcggagtctcatgctcttccttcctccccccagccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcaggtcagtgacttcctgtcgggccgttcgccactgacactggccttgcgtgtgggcgaccacatgatgttcgt

SEQ ID NO: 12704 - DNA, 416 bp, Homo sapiens
  ENST00000586843
ccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcagcccccagcggcgcccgggccgggccgggctggcggaggaggcttccggaaatacagattcattttatttaagcgtccgtggcaccgacagggaccccagagcccagagaggggcggcgagaggccccaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccg

SEQ ID NO: 12705 - DNA, 536 bp, Homo sapiens
  ENST00000590136
taggacagaagaattcgtgcaggaattccacccacttgctggccctggtgacttagctgggagggggcctgaggtggagcccctcccgtatccacaggcagagaggatctaggggcccatgagggtgggggaaaggcaaagtgaaggttgtttgaggtcagtgactgccagctgggccccgccccctctggcctcagtttccccttgcaagaccgacctagttggccagggaggggcaggcccccgtctgacccgcctctgtccccacagcccccagcggcgcccgggccgggccgggctggcggaggaggcttccggaaatacagattcattttatttaagcgtccgtggcaccgacagggaccccagagcccagagaggggcggcgagaggccccaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgc

SEQ ID NO: 12706 - DNA, 3790 bp, Homo sapiens
  ENST00000300952
gataaaggctgagggccgcgcgcttggcccagaccggcccggccagcgcgcattcggccccggacgaaggtactcgcagcacttggagcgcagaaccggccgcgcccgatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacccggctcagttcggggaagctgcaggagttcggcgtgggtgatggcagcaagctgaccttggtacccaccgtggaagcgggcctcatgtctcaggcctcaaggccggaacagtccgtgatgcaagctctcgagagtctcacggagacgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatcacagccggctccttccggtcccacgcagcctccaccacctgcccggagcagatggactgctcccccacggccagcagcagtgccagtcctggtgccagcaccacgtctaccccaggggccagccctgccccccgctcccgaaaacccggcgccgtcatcgagagctttgtgaatcacgccccgggggtcttctcagggaccttctctggcacgctacaccccaactgccaagacagcagcgggcggccgcggcgtgacatcggcaccatcctgcagatcctgaacgacctcctgagcgccacccggcactaccagggcatgcccccttcgctggcccagctccgctgccacgcccagtgctccccggcctcaccggcccccgacctggcccccagaactacctcctgcgagaagctcacggctgccccctcagcctccctgctgcagggccagagccagatccgcatgtgcaagcccccgggggaccggcttcggcagacagaaaaccgcgccacgcgctgcaaggtggaacggctgcagctgcttctgcagcagaaacggctccgtagaaaggcccggcgggacgcgcggggtccgtaccactggtcacccagccgcaaggccggccgcagcgacagcagtagcagcgggggcggcggcagccccagcgaggcctccggcttgggcctcgacttcgaggactccgtgtggaagccagaagtcaaccctgacatcaagtcagagttcgtggtggcttaggatcttcggatcggccaccctcgcccctcgcaccccagcccagggcggcggggactccgagagccccggagagaacgtggcccagccctggagggcaggcggccactcccccagccagaagtctttttttcttttcttcttttttattatttttttctttttttaaaaagttctgaccgtggtttcctggactcttcatgggctttgcttcctacctccttcacccttcactcctgccctcctcttcctcctcctcctcctcctccgtctgtctcctttcacctctgcgccaggtcggtcctccctgccaaccttccccagctccaatatgtagcagtctctctggatggcggagagtgaaggagacggagaaacgcgccccatcccttccgccgcctcctttcccccccgaccctattcaggttttaagtcaaaaatgtcgatatgtcattatgcactttacagatgaggggaggggccgcagtgcgcagaacccaccccaccccccagtgcagacttcggggtctccaccccaggccagcagcgcccactgggctacagcaagccaacaggtcacagaagccaacgaggggactgtttctcttccactcctatcctcttttcttgatcttttttttgcattttccttcatttctttaacaaggagagcaaagctgttttagcagaggctggggctgaggtccccatggggtttgggtgcaggggcatggcaccctttcctgtcgggaagggagaggggaactacccccccagcctgccctccgccccgccccagccggcggactgtgctgtttcctccgcccccactcccgtgttttctgacctcctgcctgagtttggggtatttatagactattaattttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgctgtaaatttttttgtgggagggtgggcagggaggggtcccagagggtagagctcaaggattttgggttttgttttgttttcatttttccaaaaaaaaaagaaaaaaaaatagaaaaaaaaggagtaaaaggggcgggtttgttttttgaagaactgtcttggatacctatttaaatgtgtgttctgttttgttttttaacgatttttaaataacgtctgtgcctccactggttgagggtggaacctccaggcaggaaccggctcgccaccctctgcccggtaagggctgcccaagaaagcattacccgccctcggggggtcgggctgtgggggtcccggcacctggcgtgagtttcatgtatgaaaacataaaattgaaaaaaaaaaaaaaacctacacgagcaccgtgatttcaagtaataaacagaaaatgaaac

SEQ ID NO: 12707 - DNA, 82 bp, Homo sapiens
  ENST00000385207
tgagccctcggaggactccatttgttttgatgatggattcttatgctccatcatcgtctcaaatgagtcttcagagggttct

SEQ ID NO: 12708 - DNA, 745 bp, Homo sapiens
  ENST00000304425
agacgcgcgtccccggccgcggcgccgaagccggctgggggaccgcctggtcccgggccagagctgggaggcggtgttccgtgagccgcctggtctggggtgcggggggcgggaagcggccccttcgtgtgcgcttgggcgaggccgggcggcgcttctgtcctcctactcggacccgcaggtttctggtcctcataccgtgtggttgagtgaaatcaaaacttccacgatagcaatgctgattggacaaagaatgtgttgtggacacaaaaccaaactctggaggacagaggattcattccaagggtctgcttgtattcaatgactggtctacgtgggggtgtgaagtccccttactccacctgtgaagagtcttcccagtttcagaccaccctcccagcctcctgttattggctaaggccattttgtgactacactgcaggtagagatggattcctggaaatacctcctcaaggccagtgtagagccctcaatcacccactgcccccagcttctccttctcccatctcctgcaccaagcaggtctccaggtgttccagctgctgatgacgtaaagtgtggagttggtccaggaaggtcatgttccatgcagcagaggagcgctttgtgtgagaagttgaagacctgctgtaacacatcatagaggaaagacatagcctgggccttctgcaactggctgacttccaccttctcctgggggaatctgaagtcacttctgtccttt

SEQ ID NO: 12709 - DNA, 95 bp, Homo sapiens
  ENST00000362234
ggtctctgtgttgggcgtctgtctgcccgcatgcctgcctctctgttgctctgaaggaggcaggggctgggcctgcagctgcctgggcagagcgg

SEQ ID NO: 12710 - DNA, 77 bp, Homo sapiens
  ENST00000384831
agtctagttactaggcagtgtagttagctgattgctaatagtaccaatcactaaccacacggccaggtaaaaagatt

SEQ ID NO: 12711 - DNA, 88 bp, Homo sapiens
  ENST00000580455
atgttattgctgctgctgtcacatttacatgaaaataaaatgtaaattattttatttctatcaaataaggactagtctgcagtgatat

SEQ ID NO: 12712 - DNA, 88 bp, Homo sapiens
  ENST00000638003
tgttaaatcaggaattttaaacaattcctagacaatatgtataatgttcataagtcattcctagaaattgttcataatgcctgtaaca

SEQ ID NO: 12713 - DNA, 651 bp, Homo sapiens
  ENST00000426753
ccgatgccgtatcctgccgcccgttttacccgcgggaaagccgaggcccggtgctgtattctgccgcccattttacccgcggggaagctgaggcccagtgctgtttaatatcttactcatgttcacttgatgagaaagtgacagatctgagacaaacccagttctagaggttatgacaccagccatggaagagcagagaggccaatgaggtggggaggttggaaacaaaaggccttctccaccccagcttgaccaacccaaaagctggaaggcaaggaagacctagatcgacagaaaagaaatgagtcaacgatggtgcagaaagggaccagcttgacgaagcttctgcttttgtgactgtctcctaatgcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaa

SEQ ID NO: 12714 - DNA, 471 bp, Homo sapiens
  ENST00000428772
cgcccgttttacccgcgggaaagccgaggcccggtgctgtattctgccgcccattttacccgcggggaagctgaggcccagtgctgtttaatatcttactcatgttcacttgatgagaaagtgacagatctgagacaaacccagaaagggaccagcttgacgaagcttctgcttttgtgactgtctcctaatgaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaa

SEQ ID NO: 12715 - DNA, 858 bp, Homo sapiens
  ENST00000431181
tttacccgcgggaaagccgaggcccggtgctgtattctgccgcccattttacccgcggggaagctgaggcccagtgctgtttaatatcttactcatgttcacttgatgagaaagtgacagatctgagacaaacccagttctagaggttatgacaccagccatggaagagcagagaggccaatgaggtggggaggttggaaacaaaaggccttctccaccccagcttgaccaacccaaaagctggaaggcaaggaagacctagacagaatttaagagacaccagaggatggcacatttatactgagcttgcagtttcctaaacatgaagaagatgaacggctctcagttaagcagcacgggtcagataggagcttgaaattgaatatttgagctgacacgggagagacatacttttgagattccaaatacgatttctgtggagaaaacaaaaaaggactctgtttttaattcaaaagggagaagtgaaattctacctcacttttttaaaagaagagcctggaattggcctatccgtctttttccccgttggatcacagagcagaaaggaaggtgggcgtttgtgttctgggtgttgtccacgctggacgtgccagcatctcccactgagccagatgttccagggctaaggccagtttcatttgaaggcacagccttactatatcatattaatctgatgccaagtttttggatgttatgagcaaccacctcatttattttttgtggttgtttaaccacaatgagtaagtcatgccgtgagggcccagagactgtgtcactgttgtgatgatagagtgcagggcccttcaaagggaggtctgtgggccagcagcacccaag

SEQ ID NO: 12716 - DNA, 534 bp, Homo sapiens
  ENST00000427691
cggtgctgtattctgccgcccattttacccgcggggaagctgaggcccagtgctgtttaatatcttactcatgttcacttgatgagaaagtgacagatctgagacaaacccagatcgacagaaaagaaatgagtcaacgatggtgcaggtgatctgtgcagtgctgtgcaggggatgggtcaaagctgtgatgctggcatgcaactaactcaccattaaagggaccagcttgacgaagcttctgcttttgtgactgtctcctaatgggagaagtgaaattctacctcacttttttaaaagaagagcctggaattggcctatccgtctttttccccgttggatcacagagcagaaaggaagctaagacctctagtacagtgttcaatggaactggtgagaaaagacgtccttgctgtgttcctgatatgaagaggaaagcagtccttctccattaaatgctgacaacatgagcctcccgtggtcggaacgggcttgtgaaggcggtgctggggtgcaccagggcagcagctacag

SEQ ID NO: 12717 - DNA, 415 bp, Homo sapiens
  ENST00000439507
tatcttactcatgttcacttgatgagaaagtgacagatctgagacaaacccagatcgacagaaaagaaatgagtcaacgatggtgcagaaagggaccagcttgacgaagcttctgcttttgtgactgtctcctaatgaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaa

SEQ ID NO: 12718 - DNA, 445 bp, Homo sapiens
  ENST00000457508
aatgaggtggggaggttggaaacaaaaggccttctccaccccagcttgaccaacccaaaagctggaaggcaaggaagacctagatcgacagaaaagaaatgagtcaacgatggtgcagaaagggaccagcttgacgaagcttctgcttttgtgactgtctcctaatgaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaa

SEQ ID NO: 12719 - DNA, 373 bp, Homo sapiens
  ENST00000458422
agaagagcctggaattggcctatccgtctttttccccgttggatcacagagcagaaaggaagctaagacctctagtacagtgttcaatggaactggtgagaaaagacgtccttgctgtgttcctgatatgaagaggaaagcagtccttctccattaaatgctgacaacatgagcctcccgtggtcggaacgggcttgtgaaggcggtgctggggtgcaccagggcagcagctacagggtcaagcctgagacacctgaagccctggacttggaatctgaagctgtcatcagccagtacacctatgaacctgtggaagacctgaagtacctgtttaaaagacagccaaaagataagtaaatacttcccaaatttc

SEQ ID NO: 12720 - DNA, 2043 bp, Homo sapiens
  ENST00000432910
agatgctcccaggctctcccgcagtttaaagacttaactcagcggctttcagggcctgtggttgagggactccgaaagaactgttgctggtggaccggttcagggtcttgacttcgccacacaaaagaacttgagagcacgtccaaagtaaagctaagacctctagtacagtgttcaatggaactggtgagaaaagacgtccttgctgtgttcctgatatgaagaggaaagcagtccttctccattaagtaaaatgctgacaacatgagcctcccgtggtcggaacgggcttgtgaaggcggtgctggggtgcaccagggcagcagctacagaatgcaccagctggagtcgacattaaagggccccatttcccatttgctgcagaagatgtttaattggaagtctctccctgtccttttaccctctggtgctgggcaccaatgagaagctcatctggccccgggatcctggcaggacactgggagcactatttccatgggcagcagggttgttcctggagacatcactgacccaggacacctagcacaatggcactcgatgtgaaagtggcttcgtacaaatctgccactcaagcctaaataagtgcattccagaagagccgcagcccctctaacagctcctgaggtgagggaaaccctagggatgggaagttggagcagaaagagatggtggcctgaagtcaactgcagtgaaaatctctccccatcagcaagttttgcaaagctatggccacagggacacatgactggggcccctcctagtcttggaaggagcccccatggaaatgagggcctcacagtgaatccacctctgatcctacttcacctgcagtcaaatgagaagagatttcaatcagctaaagacaccctatcccctctccccgacccctgcgaccccaggagctcctgccttgtcactgtgtccccaaacgaaccgcatctgaatcaagcccctttctctccctagtggtcaacatctgggctgtgatgggcagctcccactcttgccttagaatatgactggagaggtgacttctcatcacatggagaatatgttcaccccatggtgctttccacccaagctgaccatggcttgactttttggtgtagttgctagctctgtgccatccttggcaatgtgaccctggagcagctgtccccagtgtgcatttgggggatttcatgtaattatgaataggatgcaaattttatagccccagtgaagggaaacacccctggcgaggcttcccggggccagagagaggactccactgagggagatggtggcagggccattctttgtgtcctgcttttttttttttttttttttttaacatcctctttatgtcctgagagccatgtgcagatgaggaaaaatgacatgcaatgcatttttgcctgccacaatgactttgcaatcataacaagcaaaatgttctaaacagtaagtgaatcgaggaagatatactgccaagtcaggaagaaaaaatccacctgttcagtgatttcaggaactgctgaagaaaatcaccagtgagtatcagtttctgcaagagaatctaatgcaggctttgcttctcatcggaatcccccagctggtgtcttggttgactgagagtctgggggagagggcagagaatggatttattctctgctaggtttttaacagtcaagaagggctgtggtcctaaggggcactggtcaaaccttagtgtgcatcagaattatctggataaggctaggcacagtggctcacgcctgtaatcacagcactttgggaggctgaggcgcgtggatcacctgaggtcagaagttcaagaccagcctggctcttttagtagagaaaccctatgtctattaaaaagtacaaaatttagccaggtgtggtggtgagtgcctgtaatcccagctacttgggaggctgaggcaggacagtcacttgaatctaggaggcagaggttgcagtgaactgagatcgtgccattgtgctccagcctgggcaacaagagtgaaactctatctc

SEQ ID NO: 12721 - DNA, 499 bp, Homo sapiens
  ENST00000437035
aggcggtgctggggtgcaccagggcagcagctacaggccctgctgaaagggttgacaatgaagactctcaggccaccgtaactcatggagaagccctgagcatctggcccgcttaatgcaccagctggagtcgacattaaagggccccatttcccatttgctgcagaagatgtttaattggaagtctctccctgtccttttaccctctggtgctgggcaccaatgagaagctcatctggccccgggatcctggcaggacactgggagcactatttccatgggcagcagggttgttcctggagacatcactgacccaggacacctagcacaatggcactcgatgtgaaagtggcttcgtacaaatctgccactcaagcctaaataagtgcattccagaagagccgcagcccctctaacagctcctgagagatgacagaagagacatccaggagtagatttcaatgcacagcagcagctgagagaagccagctgtgaaaaa

SEQ ID NO: 12722 - DNA, 825 bp, Homo sapiens
  ENST00000421257
ggcggtgctggggtgcaccagggcagcagctacaggccctgctgaaagggttgacaatgaagactctcaggccaccgtaactcatggagaagccctgagcatctggcccgcttggtaaattctgctatgtctcctccagccctgaccaaacttcaaatatgaggaaaataaacattgtcatatatcaaccggccagttcccagcaattcctgcctgcgtgcccatgcaaggggaggtctggtgctgcctcctgtagtaactacctgtggagccagctgaactcattttcccctgaacttcagaaagtgccagaatcaccccagagcacttgagtacttgccctgtgaagacagcaaggaaatgggagaggatttgaaggatttgcttaagagcggctttgaagtcctccaacagggtgagagagccagctcagcacagacccagcctagagaaggagcatttttctagtgggctcatctttaatttgcaactatggcacaaaggaaggagcagctgtggagaccagggcattggtgaaatgaaagcatattgtttccctccatcttccccaccctggggaggccagggtttctccaaggcagacactctctaagtgaaatctatggaattttggaaacaagataaaagacatactcgactgcaatgcacatactcaccgtggagcccggcacgcagggtaaagactcgctgggtttgcattgcacattctcactgaggagcccggcacgcagggttcagactcgctggttttgggttggtggacttcattttctttcacgctgctgcttgcccagtgggtgtaga

SEQ ID NO: 12723 - DNA, 805 bp, Homo sapiens
  ENST00000427820
ggggtgcaccagggcagcagctacagggctctcctcccaagcacccaacgagcaagatgggtctgaggatacctgtgagaagtaattcaacacatctttcacacatgggccaatttgctggtctaagttaaattggagtgacaaggacagctgcttaaagaagacgaggtttcaccgtgttagacaggatggtttcgatctcctgacctcgtgatctgcgtgcctcgacctcccaaagtgctgggattacaggcttgagccgccacgtccggcctcagaccatttttctagagatgcaagctacagatgacagagccgaggtcgtctcctccaggtcccagagctgctatgtggctgagctgcagttcagagccagggtgactcagcttgcaagcctgtgctcctcacctccgtggcatgcttctcccaggctggcactgaatcaccggaaggactccttaagacatggataggggatccaccccagaggtcctgaatcagcaagtctggggaggagactgagaattgacttttctatcaagttccccagtgatgctgatgctgctggtgtgcgtaccacgttctggaacctccgctccctgctctagggccttctgggtggagccctagagctgagctcccagctgtgggcatggcaggcactgaagagtgttgctttagggtaatgtgttaacagtctaagaaggtgcgtggtgagtaggctgaccatttctctctcttattgaacaaaatattgctaagccctggattttctcagctgtaaatcactgaaatctgaataaaa

SEQ ID NO: 12724 - DNA, 89 bp, Homo sapiens
  ENST00000621981
atgcatcgggatagtccgagtaacgtcggggcattccggataggccgagaaagtgttgtgggaagaaagttagatttacgccgatgaat

SEQ ID NO: 12725 - DNA, 710 bp, Homo sapiens
  ENST00000317292
acctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaa

SEQ ID NO: 12726 - DNA, 879 bp, Homo sapiens
  ENST00000586721
acctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaa

SEQ ID NO: 12727 - DNA, 725 bp, Homo sapiens
  ENST00000592709
cctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcctcagggcttttgcctctgctgttcctgcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaa

SEQ ID NO: 12728 - DNA, 560 bp, Homo sapiens
  ENST00000588711
ctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaata

SEQ ID NO: 12729 - DNA, 587 bp, Homo sapiens
  ENST00000589639
caggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatg

SEQ ID NO: 12730 - DNA, 481 bp, Homo sapiens
  ENST00000591008
gggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgaga

SEQ ID NO: 12731 - DNA, 450 bp, Homo sapiens
  ENST00000592663
cagaaagggacagagacggcgaagtttgacggtctggaaagcagagaccagcagggctgactgcttgggagcacgagggacagctctccaccgaccgaaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgaca

SEQ ID NO: 12732 - DNA, 865 bp, Homo sapiens
  ENST00000588758
cagaaagggacagagacggcgaagtttgacggtctggaaagcagagaccagcagggctgactgcttgggagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctatcagaccctgcttctctccaggagaaccgggaatggaaaacagggaggcagcacagaggcaggaaactcaggtgtcatagcttggctcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaa

SEQ ID NO: 12733 - DNA, 614 bp, Homo sapiens
  ENST00000588923
cctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaa

SEQ ID NO: 12734 - DNA, 529 bp, Homo sapiens
  ENST00000589368
gacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcagcctcagggcttttgcctctgctgttcctgcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaat

SEQ ID NO: 12735 - DNA, 4778 bp, Homo sapiens
  ENST00000536780
ggagaaacacacacgggcgggcggaggggacccggggcgagtcatcaagggcgcgtggttcggcgtgccaggcgcgctgctctgcctgctctcttggcttctgtctcccttcgaccgatcgccccctatcctgaagctttccaatgtcatcttggagccccaaagtttcctggggcctccgcgttgtgcgtcccagaaccccttgcctgcccctgagggaaacgcggagccataggcagcgggacgtcgggagccagcccaggggaggccagattcagcatttggacagcggctctggggcgcagtcggcccagcgagtttgccggtgaacagcctcgggcacatggcgggtaggagggccgcagggctgctctgggtcttgaagaagcaggacccagcctagagggcatccccagctccgaatgggacacgttttcccgagataaaagatcccttctgagctcacacgggagccccgggaccatccaatccagcgtggatatccccagcctaaccaacacctgtgctggggggaaagataagacgccccctttcagccaggaggtggacgaccctcatgccctcagctctccattcttcccaaagcagctcggatccctaagtctggagctgccagcgaggcttccaacccgctgcttgccatcacctcccaggtcgttggtggctccgattactcccctgctggtgcctccctccttggcgcgcttcccacctgcgatcggcgccctcttcgcagtcacgaactcgccagcagctagcagcactgactagtaggagggcccgccggaggagagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggacatgctctggagtcagaagacagcgaaaagagaagcagaagccccggtggcaagagtctgaaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctacttcttcaccgtgtctgttcttgtcacacctagtcaggtctgtttgggtctgaggtgcatggaacattctgggtaggcctccagcaaacggaagctcttcaccgtgtttccagcctgggaccaagggcagcatactggcaaagttgccaaagcaagggactccagcctcttaggagttaatgactccctctccccagctgtcctccccttggtgctcctcttcctccctcctcctgctcacagcaggcagggcctagacccgggagccatgctgctgtgctgttgccaggggagcacggaggcagatctgagctatgcagggaaaaggcccagcctgtcaaagtgtctgagatgaaccgccgccgtccctgtgcagctgggctcagacgtgtctcagctcttgttctgtgcctgagaatggcgaaacccagtgaggttcaagggcaaactcgctattcattagtcaggggttcttgacgtcccgtctctcccagggatgagttcccccctcctctttctccccctcctatgacacattcctgggtgcctttggtgaggactgcacaccctcctcctgcctagccccctctccaaaggcccctgaataaactccccccaaggagaccaggcagggcagagacaatggctgcaggaaatcattcaggcgggacatgctggcctgccctccacccagtccccctgtgggccccactcccttctgattcagggcacccttgggcccccagcctatacaggcctggacaggaagaaaccactgggaaccaccctaaggacaacatgctagtccagtgccattcttcgctggctctgtgggtgcctttgtggcctgtaccgactggctggctaattttgtggtttctgtaccatcacatgcctattttaagacactctccagcactgtcggttagggagtgtaaattttgcaatattttctgaaatgtggcaatatcaaaatgtaaaaggcacacatacttggtcacaaacaaatggcactatttactctgtgggcatatttgtaaaagttgccaaagaattatatacaaggatgttcatcagagcatttcttttgaagagtaaagaaatggacatgaacctgtggtccgttcatacggtggaatacctatgcagctgtaaaaatcagtgtggtagatctccgtatatgagttgatgtggaaggttggccagttcacatgataaggtgaatagaataagttacagaacaggctgtagagtatgatcttatttgtagatgtttaaaactgagtcataagtatgcttatatacagatcgtttctggaagtatgtactggaagtctacctctggggagtggggatgggggagtgcactcttctatactgttatattttcttttcatgctcctaaggtacttttattggaagatgtaaagcggttcaatgtaataggcttaacttctgtcaactaagttggcgtgggtgctttaagagggtggtagtgatgttgctggagaaagtatcccacagtcactggtggcttcagccacgggccattttggggcctaataatcacatatcatcatggttgctagtgttaatcgaaaacctactaagtgccaggcttactgtctctgggtcttgcttacgtggatgtcatttttccagttgcaccaaatcgaaagaggttaattggtttgttggagttcctttgtaggtgaagggcagagccaggagcttggctagggacaggggaggtgagtgggggatggtggataggtcttggctcccagtttccttctgggcagacattgcccctctgccctgaggacctgcttgtttgggggaagaggcctttagaggcaccagggtcatgccaggtgttggacatggtgaactgggaagtgctcccatctggccacagcgcagaagtatcaccgtgctgggggatggggaacagggctgtgaatgggcctatttgcataagcagcatgtgtctggagagaaagacatcacagagcagaagagtgcgggtgcccaggagtgcacttgccacccctacttcatccctgaaagagtaaatggcctggaaggtgtctctgagaggtaatgccgcacaccaccctccctgggggcagggtcaggctacacctgccttaggtcgggggctgcagcagcctgagagctctcagtagggcctcagtagcctgggagggagcaggggcagggggcagggaaagaggcgtaatggggctgtccagaggggcctgggaaacctggtccctgaggcctgggcacagctacaatcacttcaaattggctgtggggccagtggactgggaaggaaaaaagcaataagagtgaccaagtgcagaaggctgtcaggtcccaggtcacatgccttagtgcagtgactcctcatcattttatggggtgtgggtgtcgttggtacacccattttacagatgaggacaccgaggcccagaaaagttaagttacatgtcctaagtcacacagcttgtaagtgccagaactgagatcaaaaccaagtctctttgactttaaagtctgtactctgaccccaaagagatcctgtttggccacttataggaggtccctaaagctgcagactccccttgccggcacccacatatagagacattaacccttcccctgcagggtcacctcaaatagtcttttagctgggcttctcctgcaattccacctaatgccatcccctgggttttgcccaaacctgaactgggcagtggggtgagaggaggggtttacagggttacagagcctcatacagataggagcccatggctgctggtcatctgcattcctgcaggattggctgttccttggggtccttggcaggaaaatgaggattgctccgaggcctgctccagtacttcccagaggctggcctggtgtggggctctgggaaggctgaggctggagaagcgtaagtaggagggcagagatggcactcaggtagcttgaatcaccaggacccttccaagccccacaggttctgagggagtactagggccagctctgggagaggtctcttcctatgctgtgaaccccctgcctttcttgcagcctacaacgaataaattttctttgcaaagg

SEQ ID NO: 12736 - DNA, 571 bp, Homo sapiens
  ENST00000560008
gtgcccgcccgagaaggcggcgctgggagccgctcagagcccagagaagcggcgcgcggccaggagcccccgctccgccactgccgtgcctgcctcccgcagctgtctgccatgcgctcgccggggcaggggcgcccggagggcggctagagctgggcctgagcccgggaacgcgcctgatcaggggtggcggagccgcggtccccacagccgccccacccgcgccgctgcctcgctggggcccgggcccccttcccggtccttactcccctgctggtgcctccctccttggcgcgcttcccacctgcgatcggcgccctcttcgcagtcacgaactcgccagcagctagcagcactgactagtaggagggcccgccggaggagagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggct

SEQ ID NO: 12737 - DNA, 957 bp, Homo sapiens
  ENST00000561327
aaggcggcgctgggagccgctcagagcccagagaagcggcgcgcggccaggagcccccgctccgccactgccgtgcctgcctcccgcagctgtctgccatgcgctcgccggggcaggggcgcccggagggcggctagagctgggcctgagcccgggaacgcgcctgatcaggggtggcggagccgcggtccccacagccgccccacccgcgccgctgcctcgctggggcccgggcccccttcccgttactcccctgctggtgcctccctccttggcgcgcttcccacctgcgatcggcgccctcttcgcagtcacgaactcgccagcagctagcagcactgactagtaggagggcccgccggaggagaggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtc

SEQ ID NO: 12738 - DNA, 576 bp, Homo sapiens
  ENST00000560663
agtgcgtgggggtcccggccccacacagtgctagggtccctctcgagtttctcatctgccttcaggtcactttccaccctgatgccttggcttgtcctgaagctcagggcccctgtagcttgggaaacctcccaagctccccagcgagtggctgtagaccaaggaagggaccctgcccggcttcagggaagaaaggaagaaagttactcccctgctggtgcctccctccttggcgcgcttcccacctgcgatcggcgccctcttcgcagtcacgaactcgccagcagctagcagcactgactagtaggagggcccgccggaggagagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggacatgctctggagtcagaagacagcg

SEQ ID NO: 12739 - DNA, 606 bp, Homo sapiens
  ENST00000560596
cctgctggtgcctccctccttggcgcgcttcccacctgcgatcggcgccctcttcgcagtcacgaactcgccagcagctagcagcactgactagtaggagggcccgccggaggagaggacatgctctggagtcagaagacagcgaaaagagaagcagaagccccggtggcaagagtctgaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccat

SEQ ID NO: 12740 - DNA, 551 bp, Homo sapiens
  ENST00000558692
cttcgcagtcacgaactcgccagcagctagcagcactgactagtaggagggcccgccggaggagaggaagccccagagagattggtgagggtgatttcccaggaagacgcagtgtgctctgacttctgtgacagtgagcaacgggaccagtggatgtccagatgctggcaatgagacatgctctggagtcagaagacagcgaaaagagaagcagaagccccggtggcaagagtctgaaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggat

SEQ ID NO: 12741 - DNA, 1877 bp, Homo sapiens
  ENST00000538734
tcgccagcagctagcagcactgactagtaggagggcccgccggaggagagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggaagccccagagagattggtgagggtgatttcccaggaagacgcagtgtgctctgacttctgtgacagtgagcaacgggaccagtggatgtccagatgctggcaatgagacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctacttcttcaccgtgtctgttcttgtcacacctagtcaggtctgtttgggtctgaggtgcatggaacattctgggtaggcctccagcaaacggaagctcttcaccgtgtttccagcctgggaccaagggcagcatactggcaaagttgccaaagcaagggactccagcctcttaggagttaatgactccctctccccagctgtcctccccttggtgctcctcttcctccctcctcctgctcacagcaggcagggcctagacccgggagccatgctgctgtgctgttgccaggggagcacggaggcagatctgagctatgcagggaaaaggcccagcctgtcaaagtgtctgagatgaaccgccgccgtccctgtgcagctgggctcagacgtgtctcagctcttgttctgtgcctgagaatggcgaaacccagtgaggttcaagggcaaactcgctattcattagtcaggggttcttgacgtcccgtctctcccagggatgagttcccccctcctctttctccccctcctatgacacattcctgggtgcctttggtgaggactgcacaccctcctcctgcctagccccctctccaaaggcccctgaataaactccccccaaggagaccaggcagggcagagacaatggctgcaggaaatcattcaggcgggacatgctggcctgccctccacccagtccccctgtgggccccactcccttctgattcagggcacccttgggcccccagcctatacaggcctggacaggaagaaaccactgggaaccaccctaaggacaacatgctagtccagtgccattcttcgctggctctgtgggtgcctttgtggcctgtaccgactggctggctaattttgtggtttctgtac

SEQ ID NO: 12742 - DNA, 561 bp, Homo sapiens
  ENST00000559235
agcactgactagtaggagggcccgccggaggagaggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgccca

SEQ ID NO: 12743 - DNA, 786 bp, Homo sapiens
  ENST00000558754
ctgggagtggcgcggctgcttcccgcccgcgcaggatcaggccggcccccgcgggcctggagctggatccagagctagggaaactggaaaaacaggcacaaactcggaagccgcggtacggcaagagcctaagcaaagaatcctttccaagattcacacctcgtctacaccagggcaccgcctgggcctacggccttccgaacccgaagcgcccgcagcccagagctggcatcaggccatcaggccgggaaggtcgtcgcaggccccagagtgcgggcgcggggggcgcgcgcccacaggacgcccggggttgggtaggcaggagagaagggcgccagcaggcccgcggctgtttcccctcggtccgcacagcgggcccgggaggccattttgagagcgcgaagaggggcggcaagatggctgcgtgggcacccggaaggtcgccgcgccaagggcccgctgagcccctcctcccattcgtccagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggacatgctctggagtcagaagacagcgaaaagagaagcagaagccccggtggcaagagtctgaagcaggaaggatgact

SEQ ID NO: 12744 - DNA, 569 bp, Homo sapiens
  ENST00000558982
ttaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggacatgctctggagtcagaagacagcgaaaagagaagcagaagccccggtggcaagagtctgaagggagaaaataacccagtttgggaaggacatttaaaaggggaaaatattaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcaca

SEQ ID NO: 12745 - DNA, 779 bp, Homo sapiens
  ENST00000561037
gcacgacttgttcttgccttctaaagcagagaggagcttttgtgggtagttcctacagggatacatggtagaaaattcaccaaacccagtgctggagtgtttctcttcctcagaagaaatcagatgctgttcagagcacgaaggctagaattttaccctggttctcatgctaccttgcacccaggttggatcctgagtacagtttttggcaggaagccccagagagattggtgagggtgatttcccaggaagacgcagtgtgctctgacttctgtgacagtgagcaacgggaccagtggatgtccagatgctggcaatgagacatgctctggagtcagaagacagcgaaaagagaagcagaagccccggtggcaagagtctgaaggaaggatgactgtagcctgtggattgtactgcagtaggaaactgtcctagcaaggctccactttgccccagcttcaaggtatatcgtctcaaaatgcaggggacttcagatgagttttgagcaccctttcttttattataaaaaaaattccagacagttcagccaatactgactaagggctgagaccagttccatgcttttctgtctccagaggaatttgcttccatctggatgcctgaaacgctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaa

SEQ ID NO: 12746 - DNA, 2718 bp, Homo sapiens
  ENST00000546186
atcaagcgatcctcccacctgggcctcccaaagtgttgagattacagcatgagccaccacacccagactaaaaggcagtttgattttacaaatcaaaatagcagtaatctatggagatttacttgtgagattggtaggaaacatcttaaatgtaatcaaacaataacttacatcttgatgaattcacgtgtaggtttctcttcctcagaagaaatcagatgctgttcagagcacgaaggctagaattttaccctggttctcatgctaccttgcacccaggttggatcctgagtacagtttttggcaggtgggcctgcatataagttagcaatgggggatacccagctgcctctcttcatacagctgaggttttggggagtcattcttatagcccctgggttgggcctagtcctgcaaatgaattcaccagccctaaagcccaaattgcagcctctgtcattcaccttccaggagtggaaagggcagtaagtttcatcttattattattgctattttggtggttttgttgaggttggtgtgtgtatgttagtaagataaagctctcagaaattacatagcatttgtcaaggatataagagggactgtgccacatctggctgtatagaaggtggttccatatctttaaatagagccccaggtccttagccaccagaaaggttttcaggggaagtgtgcaccctcagcagctgctgctggtgggcaggatgggcacgcatggaacaggctttcctctgtggccaggtgagaagcaggtggtgagacacagagcagtgctgggctctgcttctgaagcctccaacctttccttccctaggaagccccagagagattggtgagggtgatttcccaggaagacgcagtgtgctctgacttctgtgacagtgagcaacgggaccagtggatgtccagatgctggcaatgagtaggccttccctacgctgggtggcgtccacaccctccggcttccattgcctgggtctcctggaggtggtttgctggatgaataccgcatgcacagaggctggccttgggtttgaatatggcagccagtggacagcatgtgcttcagttatgagactgcccaggagatgcttcttccaaggcagagcacgtgcagagtccagtgctggagaggccgggtgcgcagttgacccatttccagttctgttttccctctcatgttcctctgtccccatctaggacatgctctggagtcagaagacagcgaaaagagaagcagaagccccggtggcaagagtctgaagcaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctacttcttcaccgtgtctgttcttgtcacacctagtcaggtctgtttgggtctgaggtgcatggaacattctgggtaggcctccagcaaacggaagctcttcaccgtgtttccagcctgggaccaagggcagcatactggcaaagttgccaaagcaagggactccagcctcttaggagttaatgactccctctccccagctgtcctccccttggtgctcctcttcctccctcctcctgctcacagcaggcagggcctagacccgggagccatgctgctgtgctgttgccaggggagcacggaggcagatctgagctatgcagggaaaaggcccagcctgtcaaagtgtctgagatgaaccgccgccgtccctgtgcagctgggctcagacgtgtctcagctcttgttctgtgcctgagaatggcgaaacccagtgaggttcaagggcaaactcgctattcattagtcaggggttcttgacgtcccgtctctcccagggatgagttcccccctcctctttctccccctcctatgacacattcctgggtgcctttggtgaggactgcacaccctcctcctgcctagccccctctccaaaggcccctgaataaactccccccaaggagaccaggcagggcagagacaatggctgcaggaaatcattcaggcgggacatgctggcctgccctccacccagtccccctgtgggccccactcccttctgattcagggcacccttgggcccccagcctatacaggcctggacaggaagaaaccactgggaaccaccctaaggacaacatgctagtccagtgccattcttcgctggctctgtgggtgcctttgtggcctgtaccgactggctggctaattttgtggtttctgtac

SEQ ID NO: 12747 - DNA, 3846 bp, Homo sapiens
  ENST00000375790
gactcggcgggcccggggctccccggcagcggctcctctgctaggggttaacagcagcccccgcggccgggcgggcgcggacgcttcctctccacccgcccgggaacgtggataccgcgcccgcaggatgttcgccggctgggaccggcagtcaggaaacatgagaaggcctcgctattcctgttcccgggcggcgcgcgccgggctgggtaaataaagccgagacgacggcggtggcggtggtgagcgcgctggagcccgcgtggagaacatgcggcggggatgggagtgcgcctagtctcgaggcgggagagccagccgccctgcagccggccgtcggccccgcagccacagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacagacactctggaaaacggatccaataagggtgaaagcgcagctaacagaaaaggaccaagcaaggatgacacgtattggaaggagatcaacgcagctatggccttaacaaatcttgcacagggaaaggacaaactgcagggaactaccagctgcatcatccagaagtcgtcccatatagcagaagtaaagactgtcaaagtgccgctggtgcagcagttttaagagcttgttgcttttcagatccaatggatgttctttccggtgttttcatcaaccctcatcctaagagccgaagcagggatgaaaatgactctctcccaaacctcttcttatttttaattatcccaaatatatcatttagttgcttctataaaagacatataaattataaaaaactcattttaatcaaaaatattaacttattttatgttactcaaactatgcataaaacatctgcattaccattacagtaagtgccttgcttcccgacaataagctccaacgtgggcatagttgaacaagctatgcctcaaaatgccaacgccatatgcttattagcctgtgtgcatcattccagacgggcctaatcattccaggactgaaaccagaatcgctgaaagcccttgaaatacattcaataattcatatgttaaaacttggatatctgttcagcccaaatgaaatcttccttttaaaaaacgtctacattattgaaaattgttcaatgtgcttttcagagtgacggtgagaattttatgcatgtatcttgcctgcatatttgatatgttacaaacttccaaaattcaaggtgcagcgatccacagaacgttgtacatttaagaagtgattccttcaagctaatttaaaatttcattgaacacatggtgaccaggaaaactttttttcaagcactgttggaaagcaccacaaagccctttagaattaatctggatttgtttctcaagttctgctgaagtttaaaaaaaaactttattatacaaataactcaaaattttcctgtgtaaaactaaacctgtagttttaaaacataatcctgtttgcattagagctcactgtctttttgtgatggaaactgtgttcgtatggaatgactaaaaatcttttatttggtttgtttcaaattacaattgctgatggacaatttgtattgcagcgagaacaacagaatgaaagaaatgtatctctgtgcggctatacatatacatacataaaattgatttttaaatttaaaacatatggaaaacaaaacattgaacagtttgaattttgccaagttggacattaaagtaaaaatgaagtgaaatcatgcattgaaagaaaacattttgtttctaaattagtctaccattgagtgagaataatcaatatcaagaaagaagactatctttctcaactaaacaataatattccaatcagcttgggaagacctgaaacttgaataagcagtggaaatgccaaatataacagagggtatgtgctacagagaagtaaaaagggtttgactttttatgatgggattttttttttctgggtatgtaatctattttttttttaaactggaaagcatttttgtcagtgtgaatgagggtcaatagtgcagccagtggtgacatttttctttattttgcaaaatgcttttaaaaccaaaggctgctctagttgatggacagtatcagtcttgatctaaattgtaggacactttttcatgtaacataacatttggggattgggtttatttagtgtaatgaagataatttgatataaaaatattttgtgtatatatatatatttttactttgttttctaaattgctgtttgcagtaacagtaagcgcaaagcaaaatatataagttatgactgtatgatcagatgaagtatgagttcttttggtttgcatccttaaatagttagagatctctgataaaaactttggaatctttgcaaaacaatacaaaaatgccaaaatgtgagcatgtcaatgaaaactaaagacaaatacttcactctttttcatactattataagttattctggtattaaatatgttaataaaagtgtttttgttttgacatatttcagttaaatgaatgaatgctggttgtattttatttgaatgagtcatgattcatgtttgccatctttttaaaaaaatcagcaaatttcttctatgttataaattatagatgacaaggcaatataggacaactattcacatgattttttttaataccaaaggttggaagattttataattaacatgtcaagaagactttatagtaagcacatccttggtaatatctccaattgcaatgactttttaatttattttttcttttgctgctttaacattttctggatattaaaatccccccagtcctttaaaagaatcttgaacaatgctgagccggcagctgaaaatctaactcataatttatgttgtagagaaatagaattacctctattctttgttttgccatatgtaatcattttaataaaattaataactgccaggagttcttgacagatttaaaataaaagttaatttctagacctcg

SEQ ID NO: 12748 - DNA, 1002 bp, Homo sapiens
  ENST00000460919
ctgagcactctcagccagtaagtaacgagatgcaccttcctctcctagaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacagtggaaaacttaggttctttgagtgaggactcctg

SEQ ID NO: 12749 - DNA, 431 bp, Homo sapiens
  ENST00000561227
aaggtctggtggagaggcgctcgggtagcggccaaggctggcccaagggtctgcgcggagcttgggagcccacctggccgcgcctcctttgctttaaaattattcgccggcgttgggggagggggacacttctgcagggagtgacctccccggccacagtctggagtgaatcgggaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgaga

SEQ ID NO: 12750 - DNA, 3638 bp, Homo sapiens
  ENST00000419761
aaataaagccgagacgacggcggtggcggtggtgagcgcgctggagcccgcgtggagaacatgcggcggggatgggagtgcgcctagtctcgaggcgggagagccagccgccctgcagccggccgtcggccccgcagccacagaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacagacactctggaaaacggatccaataagggtgaaagcgcagctaacagaaaaggaccaagcaaggatgacacgtattggaaggagatcaacgcagctatggccttaacaaatcttgcacagggaaaggacaaactgcagggaactaccagctgcatcatccagaagtcgtcccatatagcagaagtaaagactgtcaaagtgccgctggtgcagcagttttaagagcttgttgcttttcagatccaatggatgttctttccggtgttttcatcaaccctcatcctaagagccgaagcagggatgaaaatgactctctcccaaacctcttcttatttttaattatcccaaatatatcatttagttgcttctataaaagacatataaattataaaaaactcattttaatcaaaaatattaacttattttatgttactcaaactatgcataaaacatctgcattaccattacagtaagtgccttgcttcccgacaataagctccaacgtgggcatagttgaacaagctatgcctcaaaatgccaacgccatatgcttattagcctgtgtgcatcattccagacgggcctaatcattccaggactgaaaccagaatcgctgaaagcccttgaaatacattcaataattcatatgttaaaacttggatatctgttcagcccaaatgaaatcttccttttaaaaaacgtctacattattgaaaattgttcaatgtgcttttcagagtgacggtgagaattttatgcatgtatcttgcctgcatatttgatatgttacaaacttccaaaattcaaggtgcagcgatccacagaacgttgtacatttaagaagtgattccttcaagctaatttaaaatttcattgaacacatggtgaccaggaaaactttttttcaagcactgttggaaagcaccacaaagccctttagaattaatctggatttgtttctcaagttctgctgaagtttaaaaaaaaactttattatacaaataactcaaaattttcctgtgtaaaactaaacctgtagttttaaaacataatcctgtttgcattagagctcactgtctttttgtgatggaaactgtgttcgtatggaatgactaaaaatcttttatttggtttgtttcaaattacaattgctgatggacaatttgtattgcagcgagaacaacagaatgaaagaaatgtatctctgtgcggctatacatatacatacataaaattgatttttaaatttaaaacatatggaaaacaaaacattgaacagtttgaattttgccaagttggacattaaagtaaaaatgaagtgaaatcatgcattgaaagaaaacattttgtttctaaattagtctaccattgagtgagaataatcaatatcaagaaagaagactatctttctcaactaaacaataatattccaatcagcttgggaagacctgaaacttgaataagcagtggaaatgccaaatataacagagggtatgtgctacagagaagtaaaaagggtttgactttttatgatgggattttttttttctgggtatgtaatctattttttttttaaactggaaagcatttttgtcagtgtgaatgagggtcaatagtgcagccagtggtgacatttttctttattttgcaaaatgcttttaaaaccaaaggctgctctagttgatggacagtatcagtcttgatctaaattgtaggacactttttcatgtaacataacatttggggattgggtttatttagtgtaatgaagataatttgatataaaaatattttgtgtatatatatatatttttactttgttttctaaattgctgtttgcagtaacagtaagcgcaaagcaaaatatataagttatgactgtatgatcagatgaagtatgagttcttttggtttgcatccttaaatagttagagatctctgataaaaactttggaatctttgcaaaacaatacaaaaatgccaaaatgtgagcatgtcaatgaaaactaaagacaaatacttcactctttttcatactattataagttattctggtattaaatatgttaataaaagtgtttttgttttgacatatttcagttaaatgaatgaatgctggttgtattttatttgaatgagtcatgattcatgtttgccatctttttaaaaaaatcagcaaatttcttctatgttataaattatagatgacaaggcaatataggacaactattcacatgattttttttaataccaaaggttggaagattttataattaacatgtcaagaagactttatagtaagcacatccttggtaatatctccaattgcaatgactttttaatttattttttcttttgctgctttaacattttctggatattaaaatccccccagtcctttaaaagaatcttgaacaatgctgagccggcagctgaaaatctaactcataatttatgttgtagagaaatagaattacctctattctttgttttgccatatgtaatcattttaataaaattaataactgccaggagttcttgacagatttaaaataaaagttaatttctagacctcg

SEQ ID NO: 12751 - DNA, 3601 bp, Homo sapiens
  ENST00000395876
gtaagtgctcagacattaagccgttgagtagaggcatgttttgcaatctctcgtttagctaccaattggagcagtttaacgtgcttgagtccccggcgtgatgtgttcatggacgaagttgccgatggatgttgtcaggtgttgcacctggagggcccagatggatcaatgaggcatttaaagtgtagaatctcaccctgaacccagactattcagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtg

SEQ ID NO: 12752 - DNA, 3933 bp, Homo sapiens
  ENST00000311597
aaagggggcagcaggaccgggcccaccagccatccgggctgcccacgcaaaccacagggccgaatccggagccgcccaaggccacacagctaagccgagtgcgtgaatgcttatgtgaccgtgtgaaggaggttcccaccgtgtggctgtgggggatggaaaaaggctacttggaaagatgtagaagaccttcgagtaaacagttacgtttcagaaacagagcctgctcagaatgtgtacttggtgggattctattcttagggacgcttctttcttctgagagacccgagctctgtggcgagtggcacaggcagggccccttcctttcctagttgggttctgacagctccgaggcagtggtttacacaaccaacacgaaacatttctacgatccacccgattcctcccctcattgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtg

SEQ ID NO: 12753 - DNA, 613 bp, Homo sapiens
  ENST00000483836
gctactgagacagagaactcacatgggtgcccacccaagcgggtctgtgacagagagaatgacgcctgcagtgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaacca

SEQ ID NO: 12754 - DNA, 758 bp, Homo sapiens
  ENST00000442311
agtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggtgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtccc

SEQ ID NO: 12755 - DNA, 236 bp, Homo sapiens
  ENST00000470008
gagcaccgccgcctgccacactgtgagacagggaagggagtctgagggtcttggttttctgccctcaccactgtcaggtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgt

SEQ ID NO: 12756 - DNA, 4075 bp, Homo sapiens
  ENST00000368921
aacagccttgagatgagatcacacaaacactcaaatgtagcttctaggggaggggagaacccaggaggctgggctttctcttctcttctcaccactggaagggaggagtaaccagaaggagcggaagctaaaacacgctgtccagagaggggagctgtggtcagtgggacgtcagtgagtcagtcatagggtttgtcctgatggtggtggtggcaggtggtaagggttggggaaaaatgaagaattagaggaaacccccaacaccagcaggcaggctgtactgtgactggactctccctcaacatcccccactctgctcaaagctgagggacagaggtggatagtgctgggagggaagagaagagagggggaggagaaggagagagggaaaggggcagtggagagaacaaggccatttctgtttcttttccagggacctgaccagagctgggtggagggaaagcgtgtgtgtgggacttggcatgaaatgaccaatgatgacgagaagtgaccaggaaattccattccctaggacattagggtctctgaaacttgagggtggggtcagagtgtgaagaagacaggtcagggtgaatgtgatggtagcgcagggcagtgggggatgggaacaaagccagaaaaggaagtaagagccactggcggccactcttctttaaagcagccagaagagagtgggttgaggaaaaatgaagtcctgagctggtcagcccaggcggaagagccacccgaatccaaccccacagtgaatagggaaggggctgagaaaacaacaggagggatgaggattagacctcataaggccacgtcctgagagccaagtggtgctcagaactcgacctctctgagttccaaatggcaagagtgaaatatggaaccgggaaagccaccccccgcccccaccaagatcatactaggacttgagggtctcagagctgttgggaggtgagcagaagggatgggaaagaggtgccagggaggaaggatgtacaggctagttctctggtcctgttcgggccccaaaccggttctcccggtcccaccgcctctggccctaaggcctccaacccgcggcctgacaagccctcacatgaagcagctggagagaaagaaagaatcgagagaatggcatgggcaattctggctagaagcccggggcagcagctggtccctgtgtggagaccccgagacatggagggctgctgagggactctggagaagcggtgtggactccatatttcagccaagtgacaggcccaacaccaaccttcccttccccaggaaaggtcttctgggggcttaagaggaaagagggctaggccctaagcctcccctccccaaatatattcaatcacacagattccgtatctgtctccccccactacacaactctacctagaagttctctgctgttctcaacccttaaccggactgggacctctctgggaatctttcggaccctctccctcccacctcccccaacattccagttccttcttttccttctactcttcagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagcccggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccagga

SEQ ID NO: 12757 - DNA, 13038 bp, Homo sapiens
  ENST00000262430
gcagctgttgtggggcaccatgcgaggcttcgggccaggcttgacggccaggcgtctcctcccgctgcggttgcccccgcggccgcccgggccccggctggcgagcgggcaggcggccggcgccctggagcgggccatggacgagctgctgcgccgcgcggtgccgccgacgccggcctacgagctgcgcgagaagacaccggcgcccgccgagggtcagtgcgcggacttcgtgagcttctacggtgggctggccgagacggcccagcgggccgaactgctgggccgcctggcgcggggcttcggcgtggaccacggccaggtggcggagcagagcgccggcgtgctccatctgcgccagcagcagcgggaggcggcggtgctgctgcaggccgaggaccggctgcgctacgcgctggtgccgcgctatcgcggcctcttccaccacatcagcaagctggacggcggcgtgcgcttcctggtgcagctgcgggccgacctgctggaggcgcaggccctcaagctggtggaggggccggacgtccgggaaatgaatggggtgctgaaaggaatgctctcagaatggttttcctccgggttcctgaacctagaacgggttacctggcattcaccgtgtgaagtgcttcagaaaatcagtgaggctgaggctgtgcatcctgtaaaaaactggatggacatgaagcgccgcgttgggccctacagaaggtgttacttcttttctcactgttcgacccctggggagcccctggtcgttttgcacgtggcactgactggtgacatctccagcaacatccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcagagagagtttcctcaccttggggtgttttcaagtctgtcacctatacctggtttcaccaaatggcttctggggcttctgaactcgcaaacgaaggagcatgggaggaatgaactctttacagattcggaatgtaaggaaatctcggagatcacaggtggccccattaacgagaccctcaagctcctcctcagcagcagcgagtgggtgcagtcggagaagctggtgcgggcgctgcagactccgctgatgaggctgtgcgcctggtacctgtatggagagaagcaccgcggctacgcgctgaaccccgtggccaacttccacctgcagaacggggcggtgctgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgtaaagcattgaacatctgattgtgtagtggtggtcgtctttaagattagagacctgggaaggctggaatcagccagccagcctacggggagtttgggatgaaggagcctggggtgtgttggatgagaacaaaggtgaaggaaggggcagtcattgtgcttgtgggaggaaggcagttgtgtttgtgtgtgtatgtgtgtatcagtgcacatctgtgtgcatgtgcacgagcgtctctgtgtggatcagtgcacgtctgtgcgtgtgcacgagcgtctgtggatcagtgcacgtctgtgtgcgtgtgcacgagcgtctctgtgtgtatcagtgcatgtctgtgtacgtgtgcacgagcatctctggatcagtgcacgtctgtgtgcatgtgcccgagcgtctctgtgtggatcagtgcacgtctgtgtgcgtgtgcacgagcgtctctgtgtggatcagtgcacgtctgtgtgcgtgtgcacgagcatctctgtgtgtgtcagtgcacgtctgtgtgcgtgtgcacgagcgtctctgtgtgtatcagtgcacgtctgtgtgcgtgtgcccgagcgtctctgtgtggatcagtgcacgtctgtgtgcatgtgcacgagcgttctatgtggatcagtgcacgcctgtgtgcgtgtgcacgagcgtctctgtgtgtcagtgcacgtctgtgtgcgtgtgcccgagcgtctctgtgtggatcagtgcacgtctgtgtgcgtgtgcacgagcgtctctgtgtggatcagtgcacgtctgtgtgcgtgtgcacgagcgttctatgtggatcagtgcacgcctgtgtgcgtgtgcacgagcgtctctgtgtgtcagtgcacgtctgtgtgcgtgtgcacaagcgtctctgtgtggatcagtgcacgtctgtgtgcgtgtgcacgagcgtctctgtggatcagtgcacgtctgtgtgcgtgtgcacgagcgttctatgtggatcagtgcacgcctgtgtgcgtgtgcacgagcgtctctgtgtgtgtcagtgcacgtctgtgtgtgcacgagcgtctctgtgtggatcagtgcacgtctgtgtgcgtgtgcccgagcgtctctgtgtggatcagtgcacgtctgtgtgcgtgtgcacaagcatctgtgtgtgtcagtgcacgtctgtgtgcgtgtgcacgagcgtctctggatcagtgcacgtctgtgcatgtgcacacgtgcatgtgcatgtgcttacacgtctttgtgtgtctgtgtgcgtgtgtccgcagttgccctgtcctcgctgtcctcggtttggcagacaggtccctcaccttccttgcctttcatctcctgtgaccctcgccaggccccttctctgtcttctgcgtacggcgtgttgcttcgtgacagacggtgtgatcgcgggagctgtctcatgcctcttgttctccgggctgattctgaaagagtggcttgcaggccaatcaatgcaatcctggcaacctgcccgcccttcttgcgggcagagttctttaccgtaagcgtccccagaccctcaggcctgcggaaacctgctgggccttaccgtctttgcttagcttttggcctagaccttaaagaccagcagtcttctgtgctttatcctgctgcctccagagtgccatggacagatcacccattctcgatcactccggcagcctttcggatccggtggcgcccttcctggctgtgtccttcacctgtgctgtctggttctctcctgtgtggacaggggatgataggaattcccgctgcacaggccgctgggaggacgggctcaggtgacatctgccgaggctttggctcaccagaggagtttgtagatgtcagtcatccccaagtcactaggaactagcacgcctgaggtaggtctcggaatagtgttcaaatccattttactattgcggccaaggagccctccctccagcaaggcggctcatcacatcacgttactctttaggtcaaatgtaaccctcccggttttatttatcactcaggcagagtttcttaaccttttgtgagttacagatcactgaaattctggtgaaagccaggtaggcctcgccgcaggagaacacatacatggtgcacagaacacacacagtgcacagaacacagtgcacaggagaacactcacagtgcacaggagaacacgcacacggtgcacaggagaacacgcacacatgttgcacaggagaattcacacacagtgcacaggagaacacacagtgcacaggagaacacatggtgcacaggagaacacgcacacacggtgcacaggagaacacacacagtgcacaggagaacacgcacagtgcacaggagaacacagagtgcacaggagaacacatggtgcacaggagaacacgcacacacggtgcacagaacacacacagtgcacaggagaacacgcacagtgcacaggagaacacggtgcaccggagaacatgcacacatggtgcacaggagaacacagtgcacaggagaatacagactgcacagaacacacgcacagtgcacaggagaaaacgcacacacagtgcacagaacacagtgcacaggagaacacgcacacagtgcacagagaaccacacagtgcacaggagaatacgcacacacagtgcacagaacacagacacagtacacaggagaacacgcacacacagtgcacagaacacagccagtgcacaggagaacactgcacaggagaaccacactgcacaggagaatatgcataaacagttcacaggagaacacgcacacacagtgcatagagcacagacacagtgcacaggagaaccacacaatgtacaggagaatacgcacacacagtgcacaggagaacatacacgcagtacacagacacagtgcaccggagaacacagtgcacaggagaacacgcacacacagtgcacagaacacagacacagtgcacaggagaacacacagtgcacaggagaacacagtgcacaggagaatacacacggtgcacaggagaattcacacacaatgcacaggagaacacagtgcacaggagaacacacacacacactgcacaggagaccatgcacagtgcacaggagaatacacatggtgcacagcagaattcacacagtgcacaggagaacacacacagtgcacagaattcatgcacacagtgcacaggagaacacacacagtgcacaggagaacacagtgcacaggagaacacacactgcacagaacaaatgcacagcacacaggagaacatgcacacacagtgcacaggagaacacagtgcacaggagaacacacagtgcacaggagagaacacacagtgcacagaacacacagggcacaggagaacacacagtgcacaggagaacactgcacagaacacacggtgatcagaacacacagtgcacaggagaacacacagtgcacagaacacacggggcacaggagaacacacgatgcacggaacacggtgatcagaacacggttcacaggagaacacacagtgcacagaacacacggggcacaggagaacacacagtgcacagaacacacagtgcacagaacacacggtgcacaggagaacacatggtgcacaggagaacacacggtgtacagaacacacggtgcacaggagaacacgcagtgcacaggagaacatgcaatgcacgggagaacacagtgcagagaacacacacgcactgcacagaacatgcagtggtgcacaggagaacagtacacaacaacacattccatgcacaggagaacacacgcaattcacaggacacaacagaacacacgcagtgcacaggacacaacagaacacacgtgcacaggagaacacagtacacacacagcgcactggagaacacgcacagtgcacaggagaacagagtgcacagaacacagtccacaggacagcacacggtacacagcagaacacccgcagtgcacaggagaacctagtgcacagaacacacaccctgtgcacagttttgttttgttttgcttttgcaattccagggagctccctggcctcccacagccattcatagagcccattctgtttgcgataaaaacagatctcctccagctcacgtgaggctaggcacgggttcctcaaaacctttttgggcagctagcagctttgactagcagctcatctcaccaggctgaggtcgctgcctgtgaacagttgacagacctaaagccagccagaatgttctgtgtcagagagccctgtccaatgggcagagctgggagacacgcaggaagacccccagcccatgcccgttctcaggcctgaggttcattctcgttctctccctcttccctttccccttcctccctcctgccctcgaatctgcaaggtctctccgggtggctgtgttctgccagggcctcccaggctccaagatcactgccttcagggagcccaggaagagctgcacatccgctgcctctgtgtggcaggcgtgtccgagactgcaactcctagttcccacctttcacacctcatctctctaacctcttatggaaaatttcaaacatatgtaaaagcagggagaaattgcataacgaacctacagacctatcacccagcttccacagtcatcagtggttttctgtttttatcaaactttatctttgtacttcttacagtgcttcacatttagcaggtcctcaatgaacattagatggatggatggaaggaaggaagatggatggatggatggatggatggatggatggatggatggatgacagatggatggtggagggttaatggaaggaaggaagatggatgggtggaaggaagatgggtggatggatggtggagggtggatagaaggaagatgggtatatgaatagatggctgggtgggtggaaggaaggaagatggttggatggatggaagatggatggatggatggatggagggtagagttttaatggaaggaagatggatggacgaatagatggaaggaagatgggtggatggaaggaagatggatggatggaatgatggatgggtggtagagggtggatggaaggaagatggatgaatagatgggtgggtgggtggatgtttggatggatggtggagggcagagtgttaatggaaggaagatgaatggatagatggagggtagagtgtagatggaaggaaaggaaaggaggatggatggatggatggatggatagatggatggaggagggtggatggaaggaaggaggatggatggatggatgggtgggtgggtgggtggatggatggcgcagggtatatggaaggaagatggatgaatgatggaagatggatggatgggggacagatgaattgatggcggaggatgttaggatgggtggatggatgtattaacatcccttctccatgcctcagtccccatcataaggagaaagagcctgtcgtccctctatgatactgcactgaaccaatattcccctcacttcatgggtgttacaaacctcttatcatctgtttacgtctcactcttactgtagaacctctagaaaggcaggtggcttccagctcctcgcttttcctgagggatgatctgaccacccattcttacacatgtcatctttcccacagtggcagtgcagaggagacaaaagcagaacaaaagcagacagcggccaggtctgagggtgataggctactcactgggtcctagtgttctgaactacaccctacaggaaagtgctactcagtgcccaggtgacatcgtcacaaggggaacacagtggctaagagggcaggggctcagtctcacagacctggtttccatcccacttgctctcaggaaccctgggcaacaactgtgaccacagtgtcttcctctggaaagtgcccagcagtgttgggctcaccgtagctgcacaataaattgtcatgagtgctttccactgtgtcccaggttcaaggctgaagtcacaaccccacccctgccacagagcctgcccccccgagtgttccccatctcagtctgaggcccgacctgtgcttccggagcccgcgtcccgtcccatctcaggagctactctgctccattccccccgtatccgagacctaagttccggctctccttatctcttggagccctgtcatctgtggatcagatgctccccagctccctccatcccacccacagggtttcacaagaggcccagccatgcaccctgctggggttcagacttgaggggtgccactggagttggggtgcacctgctctcacctgttcatgggctcctttttcttctgaaatgcagcgtgaggcaccatggagggagctgtagactttggctccggccagtgcccagttcaaatgctggccccaccacttccagctgggtggcccagggcaagccacctacccttgctttgcctcagtttcctcatctttaagtggcagtaaccatagtaccgaccccacagcctgctgagaggctcaaaggagacgatgtatataaagcagttaactgatgcctgccctgggaagcagagcagtccctgtcatgatgggcgtttctacatctggacctgggcgccaccatcctgctcacctgaatgcgggttctgggatctttcagtccttatttggatatttgaatatttgttggttttctggcttctcacaatttctaagaggtgactaagtggatcattcgttcccgggagaggtgggaatggctcctgtggacacggcattgcacaggggcttgaggggacctcctgacccctgatggctgagcacccttgtcatactcctcagggagagcccaggccaccggctagctccagactggctctgcagggcctcagaatctgaactccctgtggtcactctgaggcctctctgtctctctgtgtctttctctttctaccctctccatccctccttccctctgagggcttgaccttcactgacctccagggcaagaacaaccaagagttgctcccaagagggcttccctcctcctcgttctgtgtggcctcagaagtgagggaatctcagtgctctgtgcaggcatgtgcttattctgagctctgtttgaaattaaacatgaggtgtactaaagatttaaatcgagcaaacacctctgtgatttccaattggattctgaggcgcttacagaaatatgaagtccattttgatctactcttagaaacaaaagctgcccatgatttcaccacagaaagtctgcctcatttgcagtttagcggactcacagaggtgaccctagatctctgtctcgcctttgtttggtttatttccacattgcatttgcgtttcccgcctggctagttcttgatcattgaggaaggcagagagaaacgagattctctgctctgggccaggcattctctgtacacgttcctggttccagcctgcctccttccctagaggatcaccgtgtccagccctgaagctggagcgagtgttcctcacttagagatgaggcgatgaggcggcgagctgggagagggctgagcagctggtgagggcagagttgggactcaaacccaggcccgaccaccacccagctctccttccaccgcactggtccacctcctgaccgtacgtggggagacccacgcaaaggcccagagaggagaaggccagcagtgggcagaacagagtgggccgcaggttttggcaagcctggaggggaataggtcagaaaggtagcccggctgggctgagagactgaggacagggggtgttagggtgctgacattctggcaagggggcgggggtctgtggaagacaaccccaggctggggtggcttctctcaaacccgggcatgcacagtgctggccgtatcggtccgagccctcggctgccagggagagaagctgagctcccaccaaagcataaaatccaggccagcgaggggcagccagaccacgggaagacaggaggaacccggacctggctctcgtgcaggaagcaggcagtgcacagctccgccgccacagagacagcctcctctcatgaccccagactcagcccgggccgtggtgggaacgatggttggcccggtttggagatgggggatctggccctgtggtgagtgcacccagagcaggtgtctctccggagcagttgagtagaacagctggcgtcacctcttcatgttgacgaggggagatgagtggcccaggcagttcctagagcgggggagatggagtgggccgtatcccacccagcaggagcgcttgcttctgaagctcccgtgcgtctgtgacagaggcttgaacccccggcttgttctctcacgtctgttgccgtaaatctgtctccatcgcctggcacataggagaggcttggcaaatatttttggttcactgaagaaaggcagccctcactcctgctgctcagacagcaccccctgaacgtgagttactgcctccttgagcactttcgcaggagagaagaccagagagctgccttcaaagatgccagagccatgtttatttaagcggcgctgctccagagagaactggccatttgcagtctccaccccagtgtggctcacgatgccacctctccttgccagctctcaccgaggcccccggtgacctcctagggggtacatccagccaggttccccctcagcaatggccaggggccaccgtgggccacactgcacttcccaaatgctcccggcactggcacagatgcacaccctcttggccatccccacctgtgctccgccactcttagtcagccattcctctcggcttccgggagtcccctccttctctaaggatctcacccccatccgtgtctctgctgtctcctaactaccgatagcaagggcactagtgcccctgtttgccggggacaggccctgtctggggccctggtgtggcatcattgttaacagagcttcttttcactctgaagtgttcagttaggacagtcacttgcacagtcccctcactggtgacacagacaccccatacctgtgtgtttcccctgcatagctcagcagcagctcaggctcagcacggccaaggctgaatgcagatgccctccctccaaaacctggcctcctccagctgttccttcctggcgaggccacctccaactgtgtaacacagaagcctgggtgccatccctggggctcccctcacccccacctcccacccgtccccgggcccctggacagaccactggccttgttctcttcatttccctggcccaggttacaaagtctccttcctgattatgtgcattaactaacctcgcaggtgctctgcccacctgcctacgccagactcttccagatccttctccaccccagcaggcagagttgtcattgtgaaatgcaaatcaggttccatctctcctctcctttcctacctcccaccatccccgtcaccctccctgtcacacacagccccctccgtggcctctcaagcctgctgtggcctgaccctcccctctgcttttccaggccctcctggcactgtcctccctcagtctgggactccctgtcctccctccttcctgcgtggcacatgctcctccctcttcttgaaacgctctcccctccctgcctcccaggcaatgcccactctgcctccaaagttcatccatcgtcctctcctcaggaagatttccctggtggcttgactaggtcacagtccccctttatttgccgtcttctcactggggcctctccttcctggtagcttctaaacaaggcagtttcatgtgtgtatctccactagactagacgctctctgagggcagggaccctgcttcgcttctggcccgaggtggctgcagggtctgcaagatcatcagggccccctccaatgtgacacttgcagaggggacccctggcctggggccacgctggttacttgggtacactccttgcccagggttccacagccccttaaaggcagggtctttctggccacgcctggccctggtctggcctccccaaggagccctgccgctgggggtgctgtgtgggaacagagcacaggccctccctcccagagcccacgagatctcactttctccaagcccagctccccaaggactcagaccccagttgccctgcactgaacgctggcttgccctagctcactcggaccccaccctgcactgggaaggagggtccctgtccccgtttgacgggtgacgacactgaggcccagagagctgaaggggctggccgaggggacgggcttgggcgcttccattctcacactgctgccgtgacacctaatccatccggggaagttccctttaaacccaaaaggggacggtgaagccacacgcggccgcccttctcaggagcccacttccacctctcgcaggctagacagcgttccccaagtccccccttgagctgggtgggctgcccagctgtgaacacaaggacacctccgatttcgtcctgtgaatgttgatattagtggtcccttccttcaggggctgtggggatctcaaaagataaggcaggtctggagtcctgcgcggtacctgccgcatggcaggctctttacggacagcgcagggacgcactttgatgctgaaaatgagtctctgggacagatggatcccagtctgggtcctcgcaagcgctgtgcaccccgtcgccgcgagatggcggtgttgcgcccctccagcctcctctgctctgcgcttgggcgctgaatgttaaaattcctaacaggtgaatcgcttgaatccgggaggcggaggttgcagttggccgagatggcgccactcactccagcctggcgacagagcgagactacgtctcaaaaaaaaataaaaataaaaaaataaaat

SEQ ID NO: 12758 - DNA, 4489 bp, Homo sapiens
  ENST00000569024
atgaaaaagtcaaacaaaggtatatttcctaaaagaaaattatataggactgcttatagcctcttgagaaatttgaaaaacctagggttcagagaaaaggaggaaaaacaattcagtggtgggaaacgtcagtcctttaggagaagctgaaggaactggagctgtttggtctcaaggatccgtgtgttatcgctgagtgttggccggagagtttatggagcaagtttttgtttgcacaaaggcctaaaagagacagaaaggggcatacattgctcttcaacaaagtttgcatgaaaatttcaagaaacgatgcagtgctgaggacccccaggcacgcggtggagtcgcctcctccagagagttttcaaaacagagcagcttttaggctctgtagcctgaaccccagctggggagccgaggtctcttccagctccttcagtgctctgagaattgtcttctcgtcccagcaacaggcttgcctcgtgggctgcagagcggccaggccacccttagaaccatcgttggtgttttccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcaggtaagcgacacgcagggagccccggtcacgcttggcttccgtgtggtcaggtcagcgaacctcgtggggtgtcaggtgccatgagggacacagatgaagacaggagctaaagggaggggcagggggtagaaaaggtgccagagaccccttggcaactcctaggagccatgagtctcccagagagatgagaatgatgctgagagaggcctccaacccagctgcccagttgactgcaagacgcagttgtattctgaggtcatcaactctctctagggtgacctcgttctgacctggtcaggacactctggatttcacgtgtcatcctggtgtaagtgtcactctgaaatgtcccagccagatggcacagctggtagtcatcctgccacgcctgtcctccccctgcccctgcccacactctcagggcctctgacacctgatgtgctgttagcttgggccttctcatggcctgtgagggagtgctgaggtgagaccagacagctcgaaggtaaatgcatcggcttttaatctaactctcctctctttgctgccctgtgaaaaacatattaaccatcctacatcagaaatgttgatgttcactccaggcctaggctttcaaaaaccaccagcctcatcagggacttggataaattccaatgagtagaatctaataattaggtgcggtagctagatgtttgctaatgactggctctgagcagggtgttcactgtgttgggggctgcacatggctgcagcagaggccttcctttgaggacgacagtgtggagtggggacgtttacatgctcctagtaaattcataatcaatttctaattgaagccctcaggattcagctgggcgtgggcttcattaccacgccgccatgtttcccccgggtaacaatgagccgtagctcattcccacagtttcctcattcctctgtcttcactgagggtggtgattagcagggcggggtggggaaatgtatcagggtaaggaaggcaggaagaggaggagcagatcccgggattcgggggagttgggccttagcccagcagctgtcctgagggtgtcgcttaactgcccctgggcggccagcctagaagtcctcaaagggagtctggaagggaacaaatggcccctctgcgtggaggcgctcgtcagggtttacaaaagcaaaacacagctgggcgcagtggctcacgcctgtaatcccagccgaggcaggcagatcacctggggtcaggagttcgagactagcctggcgaacgtggtgaaaccccgtctctactaaaaatataaaaattaggcatggtggtgcatgcctgtagtcccagctactcgggaggccgaggcaggagaatcacttgaacctaggaggcggagattgcagtgagccaagactgcaccattgcgctccagcctgggagagacagtctcaaaaaaaaaaaaaaaaaaacagtggttcggggtgggggaaaaaccccgggagctaccacgaatgcccaacgagaggaacatggtgaggaaaatcataataggctgctttttttatattactctgtggttaaaatcttctgtttttgaattttaaatgataatgagaaaatgctcacgatataaattcatattgcaaaatataaagtaagtgtctcacccatgcaaaaatcgcatcaagaaacaccaggagtttatctgagcagactgtcgagagtggttttctcaatgtagtggagtgtgatggttttattttcttctgtcattaattttttcaaaaaatatctatagtgagcatgtgttacatttataatcagaaagtagcagattgtttgaaatgatcatgagatctctatctagttgggacaataacgattgaaccgtgtcatgtgatatggagagatacccgcagcgtccccctcctcgccctctaccccgttctgcacccgccgtggtgtggccgggcagctagtcgctcactcaccagtccctggccactcgtgtgccgagcagcagagcagcttccggggcctcacaggtggccatgggaggagcatggtgtacgggaaagacaaggcctgcagtgagtagctgcagtgcaccgagccccactccccactggccagctgtctggttttaggcaagtcccccaacactctagtctcggttttgccgacatgagaagggatggtggggacagagacgccctgccttggggagtcaggatgcctccagggtctggcacacatcaggttcctgataaatatttcctgctgggtgtggcggcgcgagcctgtggtcccagctactcagcaggctgaggcaggaggatggcttggacccaggagatggaggctgcagtgagccatgatgacaccactgcactccagctagggcaatagagcaagaccctgactctaagaggaaaaaaagaaaagctgcttgaaagaagataaacaacatgtatcagatgtcactctgaccgctacacagcagcatgtgagccgtaggttaagaggtgctcctctgttggtaacgtacctgctgaatttgtgttttctccgccttcctttccaccccaaccatgctttacagagagagtttcctcaccttggggtgttttcaagtctgtcacctatacctggtttcaccaaatggcttctggggcttctgaactcgcaaacgaaggagcatgggaggaatgaactctttacagattcggaatgtaaggaaatctcggagatcacaggtggccccattaacgagaccctcaagctcctcctcagcagcagcgagtgggtgcagtcggagaagctggtgcgggcgctgcagactccgctgatgaggctgtgcgcctggtacctgtatggagagaagcaccgcggctacgcgctgaaccccgtggccaacttccacctgcagaacggggcggtgctgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgt

SEQ ID NO: 12759 - DNA, 2372 bp, Homo sapiens
  ENST00000406755
ctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcggtacaagcttgtggagcttctctgctacgtcgtaatgggcttcttccccgccctggtcatcctctccatggcggggaaactgaggcctggcatgacttgtctaaagaggcagtaggccagcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgtgaacgttaacccagagcacagcgccaaggcctgtcttccctttattgggtagagttcttgatggctccaaggtgacttctggtgacagccagatcatccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctggaaaattggggaatgacgggccaatctgtgtttcctaaggtcctgaagaatctggcaaagagtcctgtgggttgtttatacctgggtggccagggcctccctctctgttaccaaagtccaggctggcgaattgtctctggttcagggaaaggggacagcccagcttgaagatgagggatggtgaatggctgtgaccatggcagacatcaccaatcaagtgcagcacatgggtgatgtcagaattcttcccagcacagtgttctgggcagccagtaccaatcaatttggcactcatgatgggacctctttgcccttcctgtctggtgtgctctgaaatgggataatggccagagtagctgaaaatctccaaatgggcatttgcatgcctatctcctcatctccccctcccttttgggaaactcctggagtaggcagtttgggggcggtagagggaaactgaggcgcacacccatgcagcccctgatgttctgttccaccgtagttgattctcagtagagttgggaatgaggatgctgttacttggccatttcttcccatctccaaaaatccagagacattacgagagctattcattcataagatggggcaaacagcccccaggcacttgctccctgctccatacttaaggtttgtgatgccaacatttggattctctcttggtgccaatcagtggctgttagaggctactcaggtgtaccccaaacagaaggcacatggatctggggcgactgttccaggtcctcccaacctctgaagtgctcagtagcccaacaacaaggctgctgggggcctgttcttcagcccccgtcagggcggggccagcctctctgtccaatgctgcctggacatttactggggaggtgagtagcaggcccagctccaggatctgaattggaatctcagattctctggataaagaatctgtctcaagtcaggaggtcctcattctgcgactcccaaccagggtggagtgggcacagacaggatgccttatgcttatctctagcacattccagggggttccagggttcctgcacctggaatccagtgtgtccaagccagtattaaattatctcaacacattccacaga

SEQ ID NO: 12760 - DNA, 2415 bp, Homo sapiens
  ENST00000404774
ctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcgaacagggagctgtgtgcagtttcttcgtggggaggcatgtcctaaggccggcacggcttgtcttcctgccaggtacaagcttgtggagcttctctgctacgtcgtaatgggcttcttccccgccctggtcatcctctccatgcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgtgaacgttaacccagagcacagcgccaaggcctgtcttccctttattgggtagagttcttgatggctccaaggtgacttctggtgacagccagatcatccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctggaaaattggggaatgacgggccaatctgtgtttcctaaggtcctgaagaatctggcaaagagtcctgtgggttgtttatacctgggtggccagggcctccctctctgttaccaaagtccaggctggcgaattgtctctggttcagggaaaggggacagcccagcttgaagatgagggatggtgaatggctgtgaccatggcagacatcaccaatcaagtgcagcacatgggtgatgtcagaattcttcccagcacagtgttctgggcagccagtaccaatcaatttggcactcatgatgggacctctttgcccttcctgtctggtgtgctctgaaatgggataatggccagagtagctgaaaatctccaaatgggcatttgcatgcctatctcctcatctccccctcccttttgggaaactcctggagtaggcagtttgggggcggtagagggaaactgaggcgcacacccatgcagcccctgatgttctgttccaccgtagttgattctcagtagagttgggaatgaggatgctgttacttggccatttcttcccatctccaaaaatccagagacattacgagagctattcattcataagatggggcaaacagcccccaggcacttgctccctgctccatacttaaggtttgtgatgccaacatttggattctctcttggtgccaatcagtggctgttagaggctactcaggtgtaccccaaacagaaggcacatggatctggggcgactgttccaggtcctcccaacctctgaagtgctcagtagcccaacaacaaggctgctgggggcctgttcttcagcccccgtcagggcggggccagcctctctgtccaatgctgcctggacatttactggggaggtgagtagcaggcccagctccaggatctgaattggaatctcagattctctggataaagaatctgtctcaagtcaggaggtcctcattctgcgactcccaaccagggtggagtgggcacagacaggatgccttatgcttatctctagcacattccagggggttccagggttcctgcacctggaatccagtgtgtccaagccagtattaaattatctcaacacattccacaga

SEQ ID NO: 12761 - DNA, 2335 bp, Homo sapiens
  ENST00000401401
gctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcggtacaagcttgtggagcttctctgctacgtcgtaatgggcttcttccccgccctggtcatcctctccatgcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgtgaacgttaacccagagcacagcgccaaggcctgtcttccctttattgggtagagttcttgatggctccaaggtgacttctggtgacagccagatcatccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctggaaaattggggaatgacgggccaatctgtgtttcctaaggtcctgaagaatctggcaaagagtcctgtgggttgtttatacctgggtggccagggcctccctctctgttaccaaagtccaggctggcgaattgtctctggttcagggaaaggggacagcccagcttgaagatgagggatggtgaatggctgtgaccatggcagacatcaccaatcaagtgcagcacatgggtgatgtcagaattcttcccagcacagtgttctgggcagccagtaccaatcaatttggcactcatgatgggacctctttgcccttcctgtctggtgtgctctgaaatgggataatggccagagtagctgaaaatctccaaatgggcatttgcatgcctatctcctcatctccccctcccttttgggaaactcctggagtaggcagtttgggggcggtagagggaaactgaggcgcacacccatgcagcccctgatgttctgttccaccgtagttgattctcagtagagttgggaatgaggatgctgttacttggccatttcttcccatctccaaaaatccagagacattacgagagctattcattcataagatggggcaaacagcccccaggcacttgctccctgctccatacttaaggtttgtgatgccaacatttggattctctcttggtgccaatcagtggctgttagaggctactcaggtgtaccccaaacagaaggcacatggatctggggcgactgttccaggtcctcccaacctctgaagtgctcagtagcccaacaacaaggctgctgggggcctgttcttcagcccccgtcagggcggggccagcctctctgtccaatgctgcctggacatttactggggaggtgagtagcaggcccagctccaggatctgaattggaatctcagattctctggataaagaatctgtctcaagtcaggaggtcctcattctgcgactcccaaccagggtggagtgggcacagacaggatgccttatgcttatctctagcacattccagggggttccagggttcctgcacctggaatccagtgtgtccaagccagtattaaattatctcaacaca

SEQ ID NO: 12762 - DNA, 778 bp, Homo sapiens
  ENST00000612910
gctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcggtacaagcttgtggagcttctctgctacgtcgtaatgggcttcttccccgccctggtcatcctctccatggcggggaaactgaggcctggcatgacttgtctaaagaggcagtag

SEQ ID NO: 12763 - DNA, 412 bp, Homo sapiens
  ENST00000547279
aaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaatccttggaagaactttacaactggggcgaactcccccttccccgattcccttgggctctgctctcagctctggaaccgcctgataaacatttggactccgctcaaa

SEQ ID NO: 12764 - DNA, 582 bp, Homo sapiens
  ENST00000548761
atgcgcgagagtttgttgtttcttcgacttcccagctctccagcgctctcccgccggcgcgccctccgatgggcgcttcggcctccccgggtggcccaggccttcagcggacgagtctgcggccaggcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgac

SEQ ID NO: 12765 - DNA, 575 bp, Homo sapiens
  ENST00000547596
ctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctggtgagtccaacaggcaagcaacctttctcacatctggttattatttcctacccattgtgcttatgcagggactcagagaccccctgccccactcccctcagttcctgggaagcatccgtgggagtggggaggaaaatggctctcatccttgagagaggtgtagccatcaagggtgcaccccagtgccagagagccagagcctgaggatcccttgttcttgagacagaggcgttgcgcatgaggtagcaggaagagctgggtcaggcagaggtggctgggccgcgcagtcagacctgggagagtgcagggaaggagaatgttgcccctctttatcctaacacaccccatcctctccccacgtggctggacctcagcatccagaattacacccccaaggtgggcgagtatgccacatacgaggccattcgcaagg

SEQ ID NO: 12766 - DNA, 3732 bp, Homo sapiens
  ENST00000311852
accagaggagagagcgagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttctgtcttgtttgtttttttgttttgtttaatgtatatttttattataattattatatatgaattccattcaaatcgttcctttttgttaacaaggggcatggggaggggtgggggtgggggggcagaggcgtctgaccccaggaacctgcagggcggggctgggtcggtgccctctaaggacaattttgaccttgttcaacctttccacaaagaataaattgtgtttcacattc

SEQ ID NO: 12767 - DNA, 560 bp, Homo sapiens
  ENST00000547074
agaggagagagcgagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaagtaagtgctagaccctggcaggagttctgcctagcatccactgac

SEQ ID NO: 12768 - DNA, 1740 bp, Homo sapiens
  ENST00000548162
gagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagatgttatccagtgggagttttgcaaaacacagctggagccagtggaggagcctggggaggggggactgccagagagaagag

SEQ ID NO: 12769 - DNA, 4250 bp, Homo sapiens
  ENST00000219271
cgcggggtgggctggagaggtttcctgccgtctgggaagcgtaaacggaccgcccacctgtcgggcctcggccgcccgcacctgcttgtgagaagcctgcggctggggcaccgcccccggtccccgcccgggtccgcgcattgggagcacactggccctttaagagcgcggcggccgcggcgcgcggggaggagggctgggagcgcccggagccgcgctgaactcgccggggacgtcgggcgcccgctccttggctggctcgcttgctctctcgctcgctctctcgggtcggctccctgcgcctcctcccgggactgcttggggacccgggcccggtcgggcgcggcggcgagcagaatccccgtgcaggaggcgcgcgctccgggcagcgcccggccccgggcatggacagagggagctgggcgcgcagggagcgccgcgggaccgggcggccggagcgctgagccagacaaaggctccggagttgcgcttgctctcgggagccgggccccaggcgctgggcgccgaggctgcggaacctcgccgggggcagctccggtcggccccctttcccgccggctggttccgagctcccggacctgccctgcccgcttctcctcgggcttgggaatttgccgaggcgacctaggcggctccggcggggaccgggagcccgaggtccgcggcgcgcctgccgggccaggagccagggagcgtcgcaagtttccaaggcgcgtgcgaggatccggcgtgcagtgttccgagctgggctgggcgccgagagcatgggcagcgacccgagcgcgcccggacggccgggctggacgggcagcctcctcggcgaccgggaggaggcggcgcggccgcgactgctgccgctgctcctggtgcttctgggctgcctgggccttggcgtagcggccgaagacgcggaggtccatgccgagaactggctgcggctttatggctacctgcctcagcccagccgccatatgtccaccatgcgttccgcccagatcttggcctcggcccttgcagagatgcagcgcttctacgggatcccagtcaccggtgtgctcgacgaagagaccaaggagtggatgaagcggccccgctgtggggtgccagaccagttcggggtacgagtgaaagccaacctgcggcggcgtcggaagcgctacgccctcaccgggaggaagtggaacaaccaccatctgacctttagcatccagaactacacggagaagttgggctggtaccactcgatggaggcggtgcgcagggccttccgcgtgtgggagcaggccacgcccctggtcttccaggaggtgccctatgaggacatccggctgcggcgacagaaggaggccgacatcatggtactctttgcctctggcttccacggcgacagctcgccgtttgatggcaccggtggctttctggcccacgcctatttccctggccccggcctaggcggggacacccattttgacgcagatgagccctggaccttctccagcactgacctgcatggaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtaccccagacggtcagccacagcctacccagcctctccccactgtgacgccacggcggccaggccggcctgaccaccggccgccccggcctccccagccaccacccccaggtgggaagccagagcggcccccaaagccgggccccccagtccagccccgagccacagagcggcccgaccagtatggccccaacatctgcgacggggactttgacacagtggccatgcttcgcggggagatgttcgtgttcaagggccgctggttctggcgagtccggcacaaccgcgtcctggacaactatcccatgcccatcgggcacttctggcgtggtctgcccggtgacatcagtgctgcctacgagcgccaagacggtcgttttgtctttttcaaaggtgaccgctactggctctttcgagaagcgaacctggagcccggctacccacagccgctgaccagctatggcctgggcatcccctatgaccgcattgacacggccatctggtgggagcccacaggccacaccttcttcttccaagaggacaggtactggcgcttcaacgaggagacacagcgtggagaccctgggtaccccaagcccatcagtgtctggcaggggatccctgcctcccctaaaggggccttcctgagcaatgacgcagcctacacctacttctacaagggcaccaaatactggaaattcgacaatgagcgcctgcggatggagcccggctaccccaagtccatcctgcgggacttcatgggctgccaggagcacgtggagccaggcccccgatggcccgacgtggcccggccgcccttcaacccccacgggggtgcagagcccggggcggacagcgcagagggcgacgtgggggatggggatggggactttggggccggggtcaacaaggacgggggcagccgcgtggtggtgcagatggaggaggtggcacggacggtgaacgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggcagcagcccccagctcccacctccccttgggcccacacctccttccctctctggagaaagggccctgggcctgcctcaccacggaccaaagggagtctgccagggcccctctccccagggaagcagcagcctcgcccctggcagagatgcctccctgagctagaaccctctgttccttccctgtgcctcctccctccctctccgactcacaccactagcctcaggggtctgagctccagctcctttgggcttcagctgccagtgtcctgagccccagggagagggggctggtgggtgcctaggcctgggcagtggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 12770 - DNA, 349 bp, Homo sapiens
  ENST00000570065
ccagcactgacctgcatggaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtgcgtgggctgtgaccagcgggctctgcatgccgctctcaagtccctggccaatgaggagtaggcattgctgccatccccattttgtagatgaggaacccaaggctcagtgaggattagtgacttgcccacatcatttggggaataaatggtggtactggaaatgaaa

SEQ ID NO: 12771 - DNA, 11558 bp, Homo sapiens
  ENST00000286614
tctttgagccggaaccgccggtgaacttaggcgccacgttcccggtgactgaccccggaggatggtgaacaggaactactgctgaccctgtcttcgccgctgcctctcgggggctgccgagcgcggggcccctgtctcctccccttgcccggctgtgggtgaacctgcaggctccttacccacccggaggacttttttttgaaaggaaacgagggagggagggagagggagagagggagaaaacgaaggggagctcgtccatccattgaagcacagttcactatgatcttactcacattcagcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctattcgccgtgcctttgatgtgtggcagaatgtaactcctctgacatttgaagaagttccctacagtgaattagaaaatggcaaacgtgatgtggatataaccattatttttgcatctggtttccatggggacagctctccctttgatggagagggaggatttttggcacatgcctacttccctggaccaggaattggaggagatacccattttgactcagatgagccatggacactaggaaatcctaatcatgatggaaatgacttatttcttgtagcagtccatgaactgggacatgctctgggattggagcattccaatgaccccactgccatcatggctccattttaccagtacatggaaacagacaacttcaaactacctaatgatgatttacagggcatccagaagatatatggtccacctgacaagattcctccacctacaagacctctaccgacagtgcccccacaccgctctattcctccggctgacccaaggaaaaatgacaggccaaaacctcctcggcctccaaccggcagaccctcctatcccggagccaaacccaacatctgtgatgggaactttaacactctagctattcttcgtcgtgagatgtttgttttcaaggaccagtggttttggcgagtgagaaacaacagggtgatggatggatacccaatgcaaattacttacttctggcggggcttgcctcctagtatcgatgcagtttatgaaaatagcgacgggaattttgtgttctttaaaggtaacaaatattgggtgttcaaggatacaactcttcaacctggttaccctcatgacttgataacccttggaagtggaattccccctcatggtattgattcagccatttggtgggaggacgtcgggaaaacctatttcttcaagggagacagatattggagatatagtgaagaaatgaaaacaatggaccctggctatcccaagccaatcacagtctggaaagggatccctgaatctcctcagggagcatttgtacacaaagaaaatggctttacgtatttctacaaaggaaaggagtattggaaattcaacaaccagatactcaaggtagaacctggatatccaagatccatcctcaaggattttatgggctgtgatggaccaacagacagagttaaagaaggacacagcccaccagatgatgtagacattgtcatcaaactggacaacacagccagcactgtgaaagccatagctattgtcattccctgcatcttggccttatgcctccttgtattggtttacactgtgttccagttcaagaggaaaggaacaccccgccacatactgtactgtaaacgctctatgcaagagtgggtgtgatgtagggttttttcttctttctttcttttgcaggagtttgtggtaacttgagattcaagacaagagctgttatgctgtttcctagctaggagcaggcttgtggcagcctgattcggggctgacctttcaaacccagagggttgctggtcctgcacatgagtggaaatacactcatggggaagcttccatgatgcacagtatctgctgttcttcagtcctttgtctttctttgtcattcagttctaggcctttcctctgcacgctcaatgcccagtaaaatttcaggattaactaaagaagaggagaaaaagaagaaaagattcttcttaaaagtttctaatgttattttccttctgaagtctgagcccatttctggggggagaaaaaaaaagcaaatcagaaaacccacggtttttctttttttctttttttctttttttctttttttgctttaaaacaaagggaaaaaagagtttaaacaaaaaacccacaattgaacttccaggaaagtgtgaagacccaaaacagctttgtctccaaagaagatagctctctgactgctttggatagtctcctacgcaccattttgtcaggtgggagatttggaatacacatgcaggacgttagactgttgggacagccattttccaacaaccaaggggccaaaatatctgcaatatagtaacagccttaataatacatccatttttcgttttatacagctgttctcagctatgtcctcagtgtttcatcgcatttatattcatagctattttcaaacacgaccttttaattgtttttgaagtatttctaaaccccttctttccaccttactcctccatcattgtgataatcttcccaagttgtattaggccattgccccaggccttccatgggtctgtcaggaatattcgttacaaagcagagcaagaagcagtatgtctctgaagtggattacagtggcagttattttacaaggatttgtgacactagtaacatacccgtgtaaccctttgagaactatcagaccagctttcagagtcttaggattgtcggtcttgcgatctgataaattatagaactgggcaatggtaaaaacagtcacaagttcaagaagttcaggtttttaaaacagatatcctataatgtcatataatttttaaatgatttacaagactacataaatgtgtttataacaaacagaaatgatgttacttgccaaaatttttctggcaaataaaaaaggtattttattaagattctcataaatctgaaattttatttgaaaaactgataatagcctaagtcttcttttcttttttttaggcatactgaatttctgttttaaaatccattgcatgaaaattcaatttgccttggtatatgcagttagcattgccattttaaaaatgaattaaaacggtgactctgaagttgcatgaatatcctccagtgcattacctattgcatgtccaccatagttctcaaagggttagtgtggcttctggcatttagccgtccatttgatcactgacagagccaagagaccaccaaagcatttcattgttgagtgtaatttgtcctaacagcagtattgtcattttcatgtgacctgcagagcaggtttgtatcaatatttttttcctagagaaaagtcagcaactgacagacctctttattgatttttaggagctgcttcttgcagtgaaaggctttacagccactgggctgtgaacttattagagatggtcagaatgaatgcaccccatgagtcagacattggctttgtgtgaaagccagctttgaggggattagcttttgaaacaatgaacagcttgccttgaacttgattattgatctattgactgtcattaacaacaacttaaacattgtcttctgtgaaaattttccttgaagagtcctgttctatgtctttgccctttgacctttaacttgcaaactggcacaaactgaaggaaatctggtgttgcttctccattggattagttgttctctaaaacctagtaagcatgagctgtttccttagagtggagagagtggtgatggcagatctgcagatggacactttgctctttacatgcacactctgaaaatgccctataggtagaagtgaattttaatttcattttaatataatttcaagtctaaattcatcattttagtacaaattacaaaaactataggaaaaaaaaaacctcaaatacttgaatggccagtgtggcttttatataaagcaggaattttatactagtaaaaatttcttactcatttgctaatacacatttccagatgatttttaatgagtgtaggtatacattcttatttggaaatggatagtttggctgccttgaatttatatttatactcaacgtagcatgaaaattagaatgccttttggttaaactacatgtttatgatttggttggggaaaatattttataattgtgggtggcatgctgcaaagccttgcagattgttatttcttacaacctgagcgtatatagtatgagcctaagaaaaaagaagagtaagaaaagaagaatggctttacagtaaaatatcatacaatgcagacaatattttaagaggatattggagattatgtacgcaagggccaagaaagcaagaaatgagaaccagagtcagccctgtagctttacttcagtgcttccattctagatgatgctgatattataaagagttagtcactgctgctaagcatggaggactatatacataagctcgtttatacagtgtttgcttgtgggagggtttaatccttttagggccttgatgtcaagaaaaaaataactggaaactatattttgctaaagatagaaatgaggaactgtgtcattttgggacatgtgcaaatcattgaggaactccatcaccctgcattgaaaattgatttttttttcctctaaaatgagaaagaaactgaataagcaatctgttgcctctttactcattcatcacaatatcctgattcgtcataaggctatcagtatataagggctagaaaataatcatagcattaagaaggaaggagtctatcattatgcttgaattctggcaaatgtcatgaataagggttgggtcatatttactttaatatgagacaagatttatgtgataagcaaaggcatataaggctgctcttttgaacagaacatttcagttatcaggctgtactattacaagagataagaagacaataaggacaatgtaatcacaaacagtgggattccatttgtttattgtacaccagctactttgtgggtatggttcctgactcctcttctacatgaggtttgggaaaaaagtctcaaaccaaatggaacagtgaaagggaaagtaattcatctagcacataagaatagtgattcaaaaccaatgcagaataaatttccatgggtcaataacataaggtgtcagttcagtgttactagagatatgcaaggcataaaatattttcatcaccccatcactaataacatgaaaagctcagacataggatttcccaaattgaaatgaaaacacattcatgcctgcaaaaataattctccttctgcttcatttctcattactttatctaatataaacacaaatgtaaacaaggtaatggtcttcatgtaaaatgaccatatagttaagaattttagtaaaatattgttgttctgtgtattattaaacaaatgcaatgaagtattaaaatagctgatcagtttgaatttcctgtaaagcagtaattccgcatcagaattgtagataaggttgtgaatttattgactcatttcagaacagtgtctgttgacatggcagtcagagcaggtgaatacagatgctctttctgattgcaaaggttatagagctaaattagacagcattatgtgatactagcaaagacaacttctgttataaatcagagggcaaggcttttctgaatcgatgtgataaattactaagtaatgattaccaaaaataattactaagtaataaaagatacagactggtttactgaaataagcaagtgttacatttaataattacctataatctttttttgttaacacataagcaagtgttacctttaataattacctataatctttttttgttaacacataatttggccatttcatatactgtgtacctattttcattccctctctgtgggtcattaaaaaacacaatgtggtggataagaacattgtccaaacttcactgctagttccaatacatagatgatggtgtgtaaactggattgtaggggtagtcatatttgcaagttctacatgttatgctaatatatctagtatggtacacatacacgcccacactttgtggatcttacagtggaataaatagtgtgtccatattaactaaactcaaagtgctatctgaagaggaatggatgttataagcagacagacagactgagttaaactgagtcatgaaaaaatatatattttaaagtttttggaatcatttccagaaactaataaagggaattatttactggtagtattgagtctgtgagattgtagtatatactgaaacaatcttctggatggtggtaaggtcttttttagcaaacacagtaaagagcttatttcatttctgatgctttcaagggcatattccaaagtatcacagatgtcaaatagaatatgctatataaaccaaaaatgtgcatttcagatgacctattacagcaatctcagccaatatgtaatatcacaaaatgtgtcaagtcaatcatataagaggatctaatcattcggctgtatttcatgtaccttcatgttgttgatatattgtgaccacaggaaataggtgccagagcatatgcagttaagttacaggctccacgttgcctaggagggaatcataactacatcagaaaatttttaacagttatatcttaaaaattagaattttatgtaataaataaagcggcaaccaggaatagcaacgcaacaaatatgaaagctaattattatatttagctttcatatttatataatatgatggaaatggaggaggaaaaatgagtcttttgttaaatataaagacaaactataacactccttgataatacaactggaaattttactttagcaagcataaaatagtggaggaaaaaaatccaacttcaagctctttgcactagtgatgattatgtgatatatcaatgtaatatttagccagtggtcattagatgttactgtgcttaaacacatctgatactcatgcattgccttacaggctaaaaatgtaagaggtaggtgttcagtaacctcaagttggaaagatatataatgttagaatcccctgagacaagccatttccctgaaatagaaatttacctcaatactcatgtaatctaagacacttggcgtagtagcaaagaagttgccttcatgttctagtctcatctaattgtgacctttgtctttcatgtacttctgaaatcattttccactttttccactggtgtgattttgaaacaattctgaaatatttcaggtaagattaataacatccaattacaaatatatgtttcaatattttatacgtatgtctactttgaaagttaaaccaatagtatagaaagcctaagaatgaacactgattggacatactcacagaaattaagggaaaaacacatattgtaaaattcctgtcaatgtttgagtagaatacagaagtacatagcagtcttcaatttttaaacacaattatgggcttataactggacgtgacatgcatcatttattagaacaatattatttatttatactaagtaaggatataagatcacagaagcttagtgttataacggagacttcacagacattcataactaatgttttctaaggcaaataagggcataaaccagaactcatggtcagtgcagagtaagtataaaaagttatgtatgaaagacatttatttatagagatttctgaggattctatgccttttcaacttaaagatgagtgtgtcttagaatttgttttatgcatcattggactggggatgatattcaaatgtgcactcagcgtgtcctcacattaaagggcacattgaacagtataggaaaatacatcataaactagaatgttgtacagattcatataactttcccatgtgctctgctgtagagctgaatttatatgcccttaaaaagggataagaatcaattaaatataaatacggaaatatacttatgttaggtcacttagcttcagagcaagatgtcattaacctttatttcacagagaaaaactggaagaaaagaatggtgaacaagaataaaatgataaactttttggcttatagagatgtttcttgggaattttttccacttgtttttatacatgaaaaaaatatcagtcacaatacagacatttctgtagtatttggtctgtgggtaaactggatcccaggcagaatactttttgacacaggcctttttatacatgctttatatatgatgaagctttggtgagatgtgactgcatggtaggatgcattttcctaggataggatatggtgctgcttgtacttgccaccttttatatgaatgtatgtcgctacattggcctgtcttgccaagacatggttgaatgaagcctggtgtgagctgtctatttgaaaagtcactaggatgcatgtttcatttgccgttacataatgccaatttgaacctgtttcctctatatattaacaatccaattgttaagataaaatatactttgcttgaatgaatgattttggtagtaatatgagcgttatccttaaatcaatgttacaatttttgctattactgaaataccgtcacagaggccacattattggctgtctataccattgcctgagtaaaattaggtttttaggtctttttggcatttacttcttttacagctgatgtggaatcaattattcctttatatgttcataagtacaaaatttcactatcttaattacttccaaacaaacaatttccaagcaagggtatgtgtgcctggtttttctgctcctccaattctaagatcgttatttgtttgccttctgtttctcacccaaaaatacagatggttgggaaagatacatcttattgagttgtcctatgcagtctctgtctatatttgcatttctttctattcctatcttgccttttttttttttttttacacagatttggttttcccttccctttgtgaaaaccagaattgagcagcattgtacatcagagatggtacccaggaaatgtctttgttcctcagtatttttcgtcaaaacttccatgcaaagacagtcccagcaaagttgacatacatcccaacctctctcattggcttttctaactttttatagagctattcccctgagaaaagtgaaatgctgagtatgatgggtattgcctgttgataggatagctaaggaaatttgcttttggagaatgtatcttaaataattatacaggaaagtagtcacagtatagtgttctgtttaaggtacatcatgggtacataaatgcctaaaaccttcatcctttggtctatttctctgtaagtgtaaattacatatatattagaaagagagatagaatcaaagaattaggggtgttacagaggcagctttttgctgccttggttttgactgtatcagcatttctattgcagacctctattttcaggggttttagagactcgaccataaaaatttgtttcaggcttaaaagttttgaaagatttttttaggtatctgattttaaacaaatagatcttgtttttatattataggagggaaataaatggagtttactagttcaattttgcgctaatataacttttaataaacttaactttttaaacaaaaacataaaatctaattagttcatagttggttgatgcttttttaaaagaatcaattattgaccttgagaaacttgcctgcttcatcagtatagtaacctatctttaagatattttaaaacgtgtatacctttattaacattatcttgattccagcggtggatcagtatgataatgcagatttatgacatccatataagctatctggtaatatagatttaggaatatatagtatatatgatacatatatatatatatatttactagatagattaaggagaaaaagctcccataaacttagtttgtcaaataaataccatatatttaaaaaatgcacagacatttatcattcagagtcagaatgagattcaagtaattgcaaagggaagttgtctcttgggtaaacaatacacattttatagcttcttgtgaaactaattttttcctttctatattgtggttatgggaaagtaaaagaattaaaattaatacagactttatttaaataacattaaactgtgaagcagagagaaacgccaggaaattaaatatttaggccattatcttgtggttgtctgacaatacttcacctttcttttaattccccatgatgttttcaattatggagagagtattaaaatctagatttaagtttctgcattgttctcattacactcaacactatttcattaagttcttgataatatgtagtcttctgtgtgcaaggaaagaaataaataacacatttatttgctgaatgagttttaaggtgtgcaagttgtagtgatgtttttcccacacaggattctatacacttataccatcttaaatctggcattttttttttcagatagcttctactgacaaacacaaagcttgtttgtgtgcaaatataaggctaaataaatggtgctaaagtgtattatgactgtcagataaaatcaggcaaaattttgtggtgcttaaattaattttttcattgattttattgatcagtgcattgaacagtgtttattattcacaagttgtcttttattagtaaatcaaggcctcatagcacattgttaaataaagtggttgactagtctatgtaacagctcaccaagctactatctcttttaactccttataatgttgcgtcattaaaggtcaaggggtcatgctattaatctcattgctatagaccattaacatgactgaacttttccacaaagtacttatgtttacaatgctataaccctttgactgctgcggcaacctttaaccacacaaatgtcacaagctagaatcatcagcatggttcttgccatggcaatcaaagagttaagggctgtgcagtgatttgttttgtatttattaatttatatttattttgtttccattcaaggaggggattaggggtggggcagtttttgtctgctgtaagtgtcttaacctagggaagggttaaatggctttttatactattgcatcttctgtatttaccatcaattcattgtgttgtaattaaaagaaactgtcaataaataagagaacagaaaaatg

SEQ ID NO: 12772 - DNA, 1512 bp, Homo sapiens
  ENST00000544227
atgatcttactcacattcagcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctattcgccgtgcctttgatgtgtggcagaatgtaactcctctgacatttgaagaagttccctacagtgaattagaaaatggcaaacgtgatgtggatataaccattatttttgcatctggtttccatggggacagctctccctttgatggagagggaggatttttggcacatgcctacttccctggaccaggaattggaggagatacccattttgactcagatgagccatggacactaggaaatcctaatcatgatggaaatgacttatttcttgtagcagtccatgaactgggacatgctctgggattggagcattccaatgaccccactgccatcatggctccattttaccagtacatggaaacagacaacttcaaactacctaatgatgatttacagggcatccagaagatatatggtccacctgacaagattcctccacctacaagacctctaccgacagtgcccccacaccgctctattcctccggctgacccaaggaaaaatgacaggccaaaacctcctcggcctccaaccggcagaccctcctatcccggagccaaacccaacatctgtgatgggaactttaacactctagctattcttcgtcgtgagatgtttgttttcaaggaccagtggttttggcgagtgagaaacaacagggtgatggatggatacccaatgcaaattacttacttctggcggggcttgcctcctagtatcgatgcagtttatgaaaatagcgacgggaattttgtgttctttaaagtgaagggagacactctatctataatccaagatggttggctctacaaataccattggaaatggattctagaacaaaggcagtcagtgcctgtgctctcaagacaaactgaaaagcacaagacctatgaagaattatcttccatcacatactaacaaagaacaatcaggaattgaaaatttaaaataaaaggccatttacaattgcattcgtaaacaccaaataccgagggatcaatctgcaaaaaaatgtgcatgacctctacattgaaaacaacaaaacactactaaatg

SEQ ID NO: 12773 - DNA, 551 bp, Homo sapiens
  ENST00000522726
aagaaagaatggagccgcccaagttcctgggtgcctgcctcggggatgcgggatgggagatactgtcgaagagctgtgctcaaaccagggcccttgtcgcgggctggatacctccgcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctat

SEQ ID NO: 12774 - DNA, 605 bp, Homo sapiens
  ENST00000520568
gagggagaaaacgaaggggagctcgtccatccattgaagcacagttcactatgatcttactcacattcagcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacaggtataagaactcacgattaatctccccttttccccatatttcattactatttgttttgacacatagtttagtatcttctgcacgttgactacatgttaatatatagggatataatgttaacataagagatttaaaattgctattgagagga

SEQ ID NO: 12775 - DNA, 3235 bp, Homo sapiens
  ENST00000570308
acatccgagatgaacccagcccttggtgttcaaaatcactttaaggggaagtagagctttttctttcatgtacctggaccagtagttcacttactctgaaagtcaagaggccccatggactgcccagcccagctgctgtggaatgtggcagagaaagagggtgagagggcctggatgactcccatgctgggagtattatgcaaacgtgggagaaaaaaacatgcttcctctcctggcctacaggagcgcttgaaagcctgctcatctgcaagccctagggctggactctacatcacagcagtggatactccatctccattgagaacccgatgactggtcactgcccagccccaccctcgacccaaccaggatgaagaatgggcaagccagatagctacagtaatcgacagacagacaaacaagagcatcgtatgacccaggggccaacaagtcccaccccagtgacaccatctcacttttgcagagctcttgctcgcaaagtgcagctaggagaacccaggcctcctgatgacaaatgctccttctttctgccccccacgtgccaagagcgaggagggaagatagctgctggctcactgtgtggtcgtggcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtg

SEQ ID NO: 12776 - DNA, 566 bp, Homo sapiens
  ENST00000568715
gtgcagggtgtcctagccaagccggcgtccctcctagtagtaccgctgctctctaacctcaggacgtcaagggcctagagcgacagatgtttcccagcagggggttctgaggctgtgcgcccagatcgcgagagagcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgcct

SEQ ID NO: 12777 - DNA, 3741 bp, Homo sapiens
  ENST00000219070
tggggtgacgaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaatcttattgatgaagaga

SEQ ID NO: 12778 - DNA, 736 bp, Homo sapiens
  ENST00000564864
tgtaaacaacttttggacacatctgggcagttgctaagggctcttgccaagcgtctagcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaa

SEQ ID NO: 12779 - DNA, 1978 bp, Homo sapiens
  ENST00000543485
agatgttgtcttgtgagcgtgcgcgcgcctggctggaggggcactgagcctggccgcagtgttgccaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggagggg

SEQ ID NO: 12780 - DNA, 2469 bp, Homo sapiens
  ENST00000437642
aatgcatgcctgccctcctgggaatgaagcacagcaggtctcagcctcatcttacccagccccccactcaagatggaggtgcctggtttgaacacctctgacaaatggaagtctgtgttgtccagaggcaatgcagtgggggcttaagaagataactctggacttagaccgcttggcttcaaatcaaagagtgcatgaaccaaccagctggcctagtgatgatgttaggcaagtgacttctcagtttcttcatctgcaaactgggaaatttcctatctcagggttaaaagagaggtaatcttaggtgcttacctagcacatgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcag

SEQ ID NO: 12781 - DNA, 755 bp, Homo sapiens
  ENST00000570283
ggcaccactgaggactacgaccgcgacaagaagtatggcttctgccctgagaccgggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcgg

SEQ ID NO: 12782 - DNA, 443 bp, Homo sapiens
  ENST00000566564
agctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctgaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 12783 - DNA, 4414 bp, Homo sapiens
  ENST00000246186
gcgcggaggcgggggcgcgctggcggccgaggcggcggcggcggcggcgaaggcaggcgggccgggcgcgggccccgccgccgggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagt

SEQ ID NO: 12784 - DNA, 539 bp, Homo sapiens
  ENST00000566386
gcagctggaacacaggagggctgtggaaaaacttattgaagagcgtcgccaacaattccttgcagacaaacaacgtgaactagaagagtggcagttgcagcaaaggcggcaaggatttattaatgcaattattgaagaagaaaggctaaaacttcttaaagagcatgctacaaacttactaggctatctccctaaaggagtatttaaaaaagaggatgatattgatctgcttggtgaagagttcaggaaagtatatcaacaaaggagtgaaatttgtgaagagaaatgatatcatcaaaattggggacatggatgaaattggaaatcatcattctcagcaaactatcgcaagaacaaaaaaccaaacaccgcatattctcactcataggtgggaattgaataatgagaacacatggacacaggaaggggaacatcacactctggagactggatttttttaaaaagcaaagtcaactagatgctgctaatgagaagacacaaaggagttacaaataaaagaatggaaaaagacaagacaa

SEQ ID NO: 12785 - DNA, 2023 bp, Homo sapiens
  ENST00000260453
acttttggtcgagcggagggcgcgcagctccaccgttgccaagacgccgcgtaaacacccgagcgcgcgcagccaggtgcgctccttggggctgctggctgctgcgtttgcggcgggaggtggtggccgcggtcccacgagagggggtatttttcgtcagccaagatgggttccaaaaggagaaatttgagctgtagtgaaaggcatcagaaattagtagatgaaaactactgcaaaaaattacatgtccaagctctaaaaaacgtcaacagtcaaatcaggaatcaaatggtgcagaatgaaaatgataaccgtgttcagcgcaagcaatttctcagattattacaaaatgaacaatttgagttggatatggaagaggccattcaaaaggcagaagaaaacaagagattgaaagaactccagctcaaacaagaagaaaaactggctatggaattggcaaaactgaaacatgaaagtctaaaggacgaaaagatgaggcaacaagtaagagaaaacagcattgagcttagagaattggagaagaaattaaaagcagcttacatgaataaagaaagggcagctcagattgctgaaaaggatgccattaaatatgaacaaatgaaacgtgatgctgaaatagccaaaaccatgatggaagaacacaagagaataataaaggaagagaatgctgcagaagacaaacgaaacaaagcgaaagcacagtactatcttgacttagagaaacaacttgaagaacaagaaaaaaaaaagcaggaagcttatgagcagctgctaaaagagaaactcatgattgatgaaattgttaggaagatctatgaagaagatcagttggaaaaacaacaaaagttagaaaaaatgaatgcaatgcgaaggtatatagaagagtttcagaaagagcaggctctctggagaaaaaagaaacgtgaggagatggaagaagaaaacagaaaaatcatagagtttgctaacatgcagcagcaaagagaagaagatcggatggcaaaagttcaagaaaatgaggagaaaaggctacagcttcagaatgcgttgacacagaaattagaagaaatgctgcggcaacgtgaagatttggaacaagtgcgacaagaattataccaggaagaacaagctgaaatatataagagcaagctaaaagaagaagcagaaaagaaattgagaaagcaaaaagagatgaagcaagattttgaagaacaaatggccttgaaggaattagtgctacaggctgcaaaagaggaagaggagaactttagaaaaactatgctagctaaatttgctgaggatgatcgaatagaattaatgaatgctcagaaacaaagaatgaagcagctggaacacaggagggctgtggaaaaacttattgaagagcgtcgccaacaattccttgcagacaaacaacgtgaactagaagagtggcagttgcagcaaaggcggcaaggatttattaatgcaattattgaagaagaaaggctaaaacttcttaaagagcatgctacaaacttactaggctatctccctaaaggagtatttaaaaaagaggatgatattgatctgcttggtgaagagttcaggaaagtatatcaacaaaggagtgaaatttgtgaagagaaatgatatcatcaaaattgggtaaagcatagattttttgcatgttaccactagatgtcagcataacttttgttttacagttcagtggcattaggtatccattgtctgtttggattttgtaaatcatcactgaatttcataacttgtaaacaattatcagatacaaattaattttaatcaagctgttatttttgtactgataatttcaaaatccgatttctacaacactacagagcactgtttgcatccccatcctcaagacagtatatttaccttgactaatacagaactctaccccaaagtgaactgccttctgtctgtgtttacgaactttacttacttgatttagccagggaaataaatatttggaattttc

SEQ ID NO: 12786 - DNA, 584 bp, Homo sapiens
  ENST00000558694
aaacacccgagcgcgcgcagccaggtgcgctccttggggctgctggctgctgcgtttgcggcgggaggtggtggccgcggtcccacgagagggggtatttttcgtcagccaagatgggttccaaaaggagaaatttgagctgtagtgaaaggcatcagaaattagtagatgaaaactactgcaaaaaattacatgtccaagctctaaaaaacgtcaacagtcaaatcaggaatcaaatggtgcagaatgaaaatgataaccgtgttcagcgcaagcaatttctcagattattacaaaatgaacaatttgagttggatatggaagaggccattcaaaaggtaagttttactattcattgttactttttttttcattttgcaccttggaaacgatgaaagtcagctgttaatgctggaaatgagtagataaacaacagcagcaggtaagtgatgcctgattgtgcctcagctcggtgtaatcgtaaagacctgggtttctggagccggcctgtctttgaatcctactactgctataccttagctacggacccttgagtaagttgcttttacttttttttttttttg

SEQ ID NO: 12787 - DNA, 567 bp, Homo sapiens
  ENST00000451925
gtggtttggtagggtgagctggtgtgtggtgtggttggacctggcatggaacttaactggagtttatgtggaatgaaccttgagggccttttgtttaaactttgtgtggcctttttgtagtctttgtgtagcttttgtttttaagtggatcttcgctgaggactcatcaaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggagg

SEQ ID NO: 12788 - DNA, 561 bp, Homo sapiens
  ENST00000428261
aaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatga

SEQ ID NO: 12789 - DNA, 940 bp, Homo sapiens
  ENST00000420739
aaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtgaccaaggaggagtttaaactgaatgaacaacctcggctcctggactcattgcttcacaacccatctacccctggatgaagttatctggctt

SEQ ID NO: 12790 - DNA, 577 bp, Homo sapiens
  ENST00000415443
aaaaacaccttgtgtaatgaaaaacccagatctataacctctccctatatattctgcatgcattgaagtaggctcaaaccctcagggacctggtatagacgcagaatctgtttcacacaacaactgctatttgaagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtg

SEQ ID NO: 12791 - DNA, 566 bp, Homo sapiens
  ENST00000447324
aaaaacaccttgtgtaatgaaaaacccagatctataacctctccctatatattctgcatgcattgaagtaggctcaaaccctcagggacctggtatagacgcagaatctgtttcacacaacaactgctatttgaagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcct

SEQ ID NO: 12792 - DNA, 3051 bp, Homo sapiens
  ENST00000383754
aaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggaggtgagcagggctatctctgtgtgttgtactccagtcagggggttccagcagcacccgcaggctctagagctcaatgcacagttctttttgtttcacctgcagtcctttcttctccaggatatgcacaggcctccagggtctttcatggctcagggtcagggtggctcaagtgccaacccacatgttgtcctccaaatattcccttctatccctggcatgctgttgctgagctcaacttttaatttttgactttctcctttgtaattaatctctatctgggtttctctctttctctgtgccatttggtttccttaattagttccctgtgccagcccatagtcagagccataattggctctggggaagatccaagttattttctgagtaagatattaggcttccatatgatccagagatgcaaagaaatccctagagagtgtaggagttgtctaaatccatgtgtcagatgtagccaacgaattatgtcagaagcagagagaaaaggcctgaaaagcagctctctcccactcctcaggcccttgtctccaaccttacatgaggctttttgaacatctcctcctggcccagctggggtgagagcaagtcctcgaaggcactgcctttgagccttgctcagcccatctgaactatcccaactctagaattgactgctttcgaattgtgtgaccttgggaatgttatctggcttcaaccacaatgccctacccccagctcctctcccaaatgatcctagatacagggctgcttccccccgaccctaccccacctcgggacacaggctcatggcctcatggcacttcaccaccagaagtggtgctcagagttcctatttccacatctaaccccctaattcctgggaaagtctgaggcctggtccccccagtgctttccctggctggcctctccacattttcatctgatggtggagtgagatcaggaaaaataggacaggagctttgccttgggggagaagagagttaagtgtggaaaggggtgagttataggaggttaagcagtccaagatttctctctctgtgtaggaggccatttcctgatgtgaggggtctgaacccaattatgatgggacagggttgggcattgacttcccatctcttctctctgtttttctcccactatctgtagcccaaaactcttatggaggactttgatctttagtataggctattggtcagggccataggaactaaccccgatcctcactccaccaggatctaccacatcccctacacacaaacacatgctgtggggagggagttttcccctgggtcaagttgaggatccttagatcaccttgtgctcctgtggactggtgtgtgcgtgtgtgtgtgtgtgtgtgtgtgtgtgtgtgtgtgtgtgtgtgtgtgtgtatgttgggaaacttagctttcagagaatgtctatgggctctcattttctctctcacacaaaaatactcgggacttctccaagtccctgaggagcctgaccactgaagctgatcatgagatgactgtatgctgacacacccccttcaggggcctggccttgacttagggctgcactgtatcctcagcaacggccttgcaggagccccttttggactgctttccctattcagcccagagttggggtggtgggagaagaggggttggagtgaatccatctctattcaaattccagctgggattactctaggagtcttcctggcttgttttgggcccaaacttagctacattgtttattggctcccaaagtcgggattgaagagtgaaaagatgcaggcaatgaatccttctgcacactcctccccaacctttccagcgcttttctacttaggaggccagtggaagggaggagaggccatgccctagcccacaggggacaaggttcattgttcttccaggcttggttcactctgcttttgattcagaagctctttccctacccagcaagactacactttcttgccttctttctattttttctttttgtgcgtataaatggtatgttgtgatatattctcagtgcttgtgcccaccttggaactctgttcttgctcttcattccgcatgtgatactctggtccaagatcttggccaggtgccttctgctcaaatatcgtctcagaggtgcttcccttgaaaactcggtgctgtttccatagttactctatttgatcactctaagtttggttgtcttcatagcacttgtcaccctctggaactattctattcatttatttacttgtttaatgcttggctcttttcccctcctaacgtaaactccatgattgccaacacctgtttacttactacagttccccctccccccacattcctgacactagtaagaaccaataaacacttgttgacggaa

SEQ ID NO: 12793 - DNA, 571 bp, Homo sapiens
  ENST00000436143
aaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagcttgaaggcaggtccacgcctcctcctggaagccttcccttgactgactcctcgctgagttcacaggtatcagtcattcccaagccctcatctttggccagatgaaatgcctctgcccatgaagtttcaccttgttctctagcccaacatattgccctctcttctgtggacttttcatgccattgcaccagcacattctcatgttgcagagcatgctggccttgtatgacactcactgatgtctgtggacattcctctacctacaagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgctt

SEQ ID NO: 12794 - DNA, 830 bp, Homo sapiens
  ENST00000441980
aaaccctcagggacctggtatagacgcagaatctgtttcacacaacaactgctatttgaagcttgaaggcaggtccacgcctcctcctggaagccttcccttgactgactcctcgctgagttcacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaaggttagtagttgcttcctgtgtttactaacaccgggctgtctccatggccctcttcagccttattacccaacctgtgtaatcagctccctccattaaatcccctctgtttgaaa

SEQ ID NO: 12795 - DNA, 3388 bp, Homo sapiens
  ENST00000311042
aaaccctcagggacctggtatagacgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagctcctgccagcgtcgcttaagcagcagaggagagccctggctcccgcctccagcttcttttggccctctcagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctgattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggaggtgagcagggctatctctgtgtgttgtactccagtcagggggttccagcagcacccgcaggctctagagctcaatgcacagttctttttgtttcacctgcagtcctttcttctccaggatatgcacaggcctccagggtctttcatggctcagggtcagggtggctcaagtgccaacccacatgttgtcctccaaatattcccttctatccctggcatgctgttgctgagctcaacttttaatttttgactttctcctttgtaattaatctctatctgggtttctctctttctctgtgccatttggtttccttaattagttccctgtgccagcccatagtcagagccataattggctctggggaagatccaagttattttctgagtaagatattaggcttccatatgatccagagatgcaaagaaatccctagagagtgtaggagttgtctaaatccatgtgtcagatgtagccaacgaattatgtcagaagcagagagaaaaggcctgaaaagcagctctctcccactcctcaggcccttgtctccaaccttacatgaggctttttgaacatctcctcctggcccagctggggtgagagcaagtcctcgaaggcactgcctttgagccttgctcagcccatctgaactatcccaactctagaattgactgctttcgaattgtgtgaccttgggaatgttatctggcttcaaccacaatgccctacccccagctcctctcccaaatgatcctagatacagggctgcttccccccgaccctaccccacctcgggacacaggctcatggcctcatggcacttcaccaccagaagtggtgctcagagttcctatttccacatctaaccccctaattcctgggaaagtctgaggcctggtccccccagtgctttccctggctggcctctccacattttcatctgatggtggagtgagatcaggaaaaataggacaggagctttgccttgggggagaagagagttaagtgtggaaaggggtgagttataggaggttaagcagtccaagatttctctctctgtgtaggaggccatttcctgatgtgaggggtctgaacccaattatgatgggacagggttgggcattgacttcccatctcttctctctgtttttctcccactatctgtagcccaaaactcttatggaggactttgatctttagtataggctattggtcagggccataggaactaaccccgatcctcactccaccaggatctaccacatcccctacacacaaacacatgctgtggggagggagttttcccctgggtcaagttgaggatccttagatcaccttgtgctcctgtggactggtgtgtgcgtgtgtgtgtgtgtgtgtgtgtgtgtgtgtgtgtgtgtgtgtgtgtgtgtatgttgggaaacttagctttcagagaatgtctatgggctctcattttctctctcacacaaaaatactcgggacttctccaagtccctgaggagcctgaccactgaagctgatcatgagatgactgtatgctgacacacccccttcaggggcctggccttgacttagggctgcactgtatcctcagcaacggccttgcaggagccccttttggactgctttccctattcagcccagagttggggtggtgggagaagaggggttggagtgaatccatctctattcaaattccagctgggattactctaggagtcttcctggcttgttttgggcccaaacttagctacattgtttattggctcccaaagtcgggattgaagagtgaaaagatgcaggcaatgaatccttctgcacactcctccccaacctttccagcgcttttctacttaggaggccagtggaagggaggagaggccatgccctagcccacaggggacaaggttcattgttcttccaggcttggttcactctgcttttgattcagaagctctttccctacccagcaagactacactttcttgccttctttctattttttctttttgtgcgtataaatggtatgttgtgatatattctcagtgcttgtgcccaccttggaactctgttcttgctcttcattccgcatgtgatactctggtccaagatcttggccaggtgccttctgctcaaatatcgtctcagaggtgcttcccttgaaaactcggtgctgtttccatagttactctatttgatcactctaagtttggttgtcttcatagcacttgtcaccctctggaactattctattcatttatttacttgtttaatgcttggctcttttcccctcctaacgtaaactccatgattgccaacacctgtttacttactacagttccccctccccccacattcctgacactagtaagaaccaataaacacttgttgacgg

SEQ ID NO: 12796 - DNA, 5675 bp, Homo sapiens
  ENST00000452959
cgcagaatctgtttcacacaacaactgctatttgaaggaaaaaaaaaaaaagaagcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatcatgagaaattaccaaaatgtccaccaatagaatgagtgaatcacctgtggtatatttataaataaaaatattaaatagaaggtaaaacaaatcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataatgcaatagaataaaaatgacaacaaagtaaaagggtatcccaaaaataaaactatccttttggaaaaaaaaagatttaaaataattcctggtttgaagaaataacaaattaaaagctatatataaacggttaacaatattaggtggacatatttgtttgaagagataggtgaaagatagttgaaaagcctgggggtatattcaaggttatatgtcttagaaaacaaaaatacttgtttgggttcagttttggatctgggcttgttcttgtggcttctgatgatttctgacttggggaaaaatggggaagagttgaaatacgtccttccacccaaacctttgtttagtaataggtaggaaaatgaagaagaaaatagaatgttgcagaatgtggagggatgtaaaatggacagtactagggtagaggggaagtcagattagaggaaagaaagagcatcaggaacagtcttgtgctaggagctggtgtggccaagcacagtcggatgcccaaagatccaacaaggccatggctctgtgtccttgagtgggcacaaccattcctagccaagtttaagaggcaagtaaaaatataggggcaatgtcagatgaagtcttgttcagggtatggggctaggatgagagagaatgccacagagtatgaaggaagagtgatagatccagatgagatacagctcagagtgccacgcccccagaaagaggaatcaggcaagtactgtcccaaggcagctggagggtgagggctgagtgccctggcttcctcacttggggagaccatgggtctctgtagaaattccaatataaaggcagggaaatttgactgcatggagtcttcaggtagaaatgtttctcttgcctaaattcaggtgctaaataaacaacaaaatggtaacctctactatgaagtgtttccaatgatgggatatctgaggccattacattcctgggaataacatggtgaggtgcagggtggtggtggtggtgaaacatacgacagaccactgtaagtgagaacaaattactggcccagcccaacccacaccaaataagaaatttaatatccctttggcctgttttagattttggcaaagccaggcccatagtgcttgctgggctctctcttccacatcatccagaagacacacatttgctatggaatgattgtggaggtgagagtatagtgcatattaattcatgcaaaaagttagatattagcccagaaatgttagtaacaagaaactactgaattctctgtttgtctgttgtggaaataaaaccttctggggatgaatcaaaactatctgacaattacttgaaatgggtgaatagctaaatgtaatgtgccttggatattataactaaaaggtgctataatccagttatattttttatcttttaaggattggttctgaggagcactaccagtaaatattgcaaaaattacataaagctccaaaagctactctgtgtaaacttcttgagtgggaattctcaaccataatatctggaatatgactgataattctggatgttaactgattttatgttctgatgttttgactggttttgggaaaaattttgggaaaaaagagttttcctcgtaaatacccaacaactgggtctctgggtaaaaaggcctaatttatagagattgctaatttccatggtgtaaatatttccacaatgcagattccttccttccttttttttttttttttttttgagatggagtttcactcttgttacccagactggagtgcaaaggtgcgaccttggctcactgcaatcttcacctcccgggttcaagccattctcctgcctcagcctcccaagtagctgggattacaggtgcccacgaccatgcctggctaattttgtatttttagtagagatagggattcaccatgttggccaggctggtctcaacctctggacctcaggtgatccacccgcctcggcctcctaaagtgctggagattacaggcatgagccaccacgcccggaccatgatgcagatttcaagctatgaacatgattctctggagtttaccatttgtcttttaattggcaaatttgatgcagaattgggaagagaagcacacaattgactctcgtcagctggcacaagctggtgccagtgcaccactgtatatatccatggccctctgtgaagctagagtttactactaaaatttgtgctccataaatatacaaaggcactagtaagagaaaaaatataaagagaatataaactaaattcaaattagggagctcaaatggagaaaattgacagataatatttttgaaactttgaaaagtagtatttgtctagattcaccttttattaccttttcctttttttcttttccttttttttttttttttgagacggagtttctctcttgttacccaggctggagtgcaatggcacgcaatctcagctcattgcaacctcggctcactgtaaccttcaccttccgtgttcaaatgattctcctgcctcagccttccgagtagctgggattacaggcacccaccaccatgcccagctaattctttgtatttttagtggagatggggtttcaccatgttggccaggctggtcttgaacccctgacctcaggtgatccacccacctgggcctcccaaagtgctgggattacaggcatgagccaccgcgcccggcctgttattatcttttattaagcaaacagcgtatctatgtatcatactgagtgttctgagctgttagtttctttggtgttcatctagatggaagctggggcttccttcctttcagatattggtgctaacatgaagctgaccaaagaattgatgggatctgcacactgtaaagccggtttcaggatggctgagctgacggtcaagaaagaagagaagatatgagccgcctgcattttggggtggtggcagtgaaatttagacttgtgatttggtatgacaatatatggctttttgtgattgttaacattaatgaaaacaagaaaaattagttgctcaaaagttgaaaaatggattcataaactttttattagagtaaggcaaaagaacatattaaaatagaggtaaattagaaatgtcaataagaacccatggacattttttataaggagactttatctgttctgtccctacagtgatttatgctcttggatatttttgctgtcatcctgacaaattctagttggaatatggaacaagcttatttgtagacctagtgcctgtggcttctaaagcaattttctgaaaagagaaaccactgcctgttggaagaatagttgattccatacctcaagctagggaaaaaaaatcagaattagtctgtgaattctagatgttgagagaaagcagggtttcattagggcatcggagagtcacaagtccataggatgcaaaaaggaagatgaaataaaattgcctgaaaaacgcacctgaatttctggcattgtttactgaaaaggctgtgtattgatgaaccccaattatgtgaggtctacatttaagagtttataatcaacagtttgaaaatgcagggtgttgtttctttctataaggagacaaaacagtcagaagggagtgtcacaggacattatcacaaaatcaaagttctccatgaaatgtggttcatttgctagaaaataatgcaagcctattggagagaatcagggcttctagtgatgctagggatgaccttaagcattgtttgtaaatcacactttttcctagtctttcagcagcagctgcacagagtaggcctgcttcttcccatgaaagccacactgagttttatcaactagtagtgtgtgggcactattgcaagttatgttgtgttgtttatggccatttatccaacagtgctttcctctgtgcggggctctgcagcctcgttctatgttatttttattaccacgtgtctgtgcgcctcaggtggcaaagcagaatcagcttctctaccctcagcagggctcactatgactcactataagggaagaaaatcttacagatgtcagaaaatgttaggtaagtggacagtgataaacacaaaacagcaagtggtcagtatcaaagagaaaaacagtatgttggtgaaggagaagtatcaaagctagttaaaaaagtaacaggagaaatgtaaagggacaatactccacaaaaatttagattgtaactgagcttcttctcctaaagagatttaaaaataaagtataggaaatacatgaagaaacaaagtaaaatgccaaggtgtaagtttgaccatgaatatctagggaaaaacatacttgcactaaaacaaccaaatatgcaaaaatcaagtggaaaaacaggtcaaaataatgccagttgatgtctgtaagaactaaatgtataataaaatgagcaaaaaaaa

SEQ ID NO: 12797 - DNA, 1340 bp, Homo sapiens
  ENST00000424090
cagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctggtaacaccatctcttcccttttgttccccagccctaagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggcaaagatgtggggaaaattctcataagctactgatgagaatttataaattattatgacacctttgggttgcaatctggggatactggcaaagcagaaaattgtacaacctgtgatcaagcaataataattttaggcacccatcctagagaaaacttgaattcatagaaaaagtaggtacacgtaaatctgttcaaggaatcattgtttggcattgaaaataggagagagatcatgagaaattaccaaaatgtccaccaatagaatgagtgaatcacctgtggtatatttataaataaaaatattaaatagaaggtaaaacaaatcag

SEQ ID NO: 12798 - DNA, 911 bp, Homo sapiens
  ENST00000442631
tgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagaaccagccgccgtgccaagtcccctcagaggcccaagcaacagccagctgcgccccccgcggtggtcagagcgccagccaagccacggtcccctccgaggtctgagcgtcagccacggtcccctccgaggtctgagcgtcagccacggtcccctccgaggtctgagcgtcagccacggtcccctccgaggtctgagcgtcagccacgtccccgcccagaggtccgaccaccgccagccaagcagcgtccccctcagaagtccaagcaacagccgcgcagcagccccctcagagggccaggcgccagccgtggggggtcccccgtcaaagcttctaggttctgattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtactttgaagatgtcatcccattgtcttctgacctctataattgccactgagagatctgctgtcagtctgcttatccttccacggactcaagtttcttcaatctgaagatacatgtctttctccagggacatgtg

SEQ ID NO: 12799 - DNA, 545 bp, Homo sapiens
  ENST00000479860
gcggctgcttctaccagaagaaagaggaggactggatctgctgcgcctgccagaagaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggagtttactaccatcaagttcagtgctttgactttgatcaactgactgggtttatccaaagtacagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtattggc

SEQ ID NO: 12800 - DNA, 2142 bp, Homo sapiens
  ENST00000447285
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12801 - DNA, 2499 bp, Homo sapiens
  ENST00000419309
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12802 - DNA, 1726 bp, Homo sapiens
  ENST00000417639
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12803 - DNA, 1681 bp, Homo sapiens
  ENST00000441138
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12804 - DNA, 1612 bp, Homo sapiens
  ENST00000419274
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12805 - DNA, 1564 bp, Homo sapiens
  ENST00000442244
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12806 - DNA, 1537 bp, Homo sapiens
  ENST00000457090
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12807 - DNA, 1981 bp, Homo sapiens
  ENST00000483865
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12808 - DNA, 1731 bp, Homo sapiens
  ENST00000470227
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12809 - DNA, 1583 bp, Homo sapiens
  ENST00000433500
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12810 - DNA, 1862 bp, Homo sapiens
  ENST00000438803
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttctaa

SEQ ID NO: 12811 - DNA, 702 bp, Homo sapiens
  ENST00000481712
gggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagact

SEQ ID NO: 12812 - DNA, 774 bp, Homo sapiens
  ENST00000472402
agtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaaggtgagtagtgccatataatattaggtattaactgttgggtggccaagaacaattattctctcaactgagatgagatccctcaacccaaacatctcagtcctgggaatgatttccataaaaatgtacacatcaataaacagaaactcatgcttagggatgtctgttgcatcattattcagagtagcaaggaaattgggatcaaaatcaatgcctttgagtaggtaagtgacagaatgaacaatggtagccatactgtga

SEQ ID NO: 12813 - DNA, 2041 bp, Homo sapiens
  ENST00000553111
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaaaaataataatacaagttttcataagcacacttct

SEQ ID NO: 12814 - DNA, 2160 bp, Homo sapiens
  ENST00000376917
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaa

SEQ ID NO: 12815 - DNA, 748 bp, Homo sapiens
  ENST00000376903
ccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagact

SEQ ID NO: 12816 - DNA, 1529 bp, Homo sapiens
  ENST00000376888
cttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaa

SEQ ID NO: 12817 - DNA, 2499 bp, Homo sapiens
  ENST00000376894
agcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaa

SEQ ID NO: 12818 - DNA, 774 bp, Homo sapiens
  ENST00000469353
agtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaaggtgagtagtgccatataatattaggtattaactgttgggtggccaagaacaattattctctcaactgagatgagatccctcaacccaaacatctcagtcctgggaatgatttccataaaaatgtacacatcaataaacagaaactcatgcttagggatgtctgttgcatcattattcagagtagcaaggaaattgggatcaaaatcaatgcctttgagtaggtaagtgacagaatgaacaatggtagccatactgtga

SEQ ID NO: 12819 - DNA, 675 bp, Homo sapiens
  ENST00000396704
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctga

SEQ ID NO: 12820 - DNA, 279 bp, Homo sapiens
  ENST00000483013
atggcaagcttatcaagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgggcaattccttgaagagctacgaaatcccttctga

SEQ ID NO: 12821 - DNA, 327 bp, Homo sapiens
  ENST00000490427
atggcaagcttatcaagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctga

SEQ ID NO: 12822 - DNA, 630 bp, Homo sapiens
  ENST00000416766
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctga

SEQ ID NO: 12823 - DNA, 889 bp, Homo sapiens
  ENST00000376891
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 12824 - DNA, 1027 bp, Homo sapiens
  ENST00000376898
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 12825 - DNA, 910 bp, Homo sapiens
  ENST00000396701
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 12826 - DNA, 958 bp, Homo sapiens
  ENST00000494692
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 12827 - DNA, 1814 bp, Homo sapiens
  ENST00000431798
atggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaa

SEQ ID NO: 12828 - DNA, 456 bp, Homo sapiens
  ENST00000476244
agcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagctcccttaaagcagagatcaagatga

SEQ ID NO: 12829 - DNA, 516 bp, Homo sapiens
  ENST00000469603
agcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaaggattggttgcagtggcacgatcatggctcattgcagcctccacctcccaggctcaagtgatcctcctgactcagcctcttgaatag

SEQ ID NO: 12830 - DNA, 1077 bp, Homo sapiens
  ENST00000485211
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 12831 - DNA, 1981 bp, Homo sapiens
  ENST00000376889
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaa

SEQ ID NO: 12832 - DNA, 522 bp, Homo sapiens
  ENST00000485885
taaggaggcagtacttttctcatccaagttcatggactttctgaattttgtccccagagtcctttggtgttctaggaccccaggttaaggaaccaaaaaagacaggtgggtggggcatgagggggaacacatgttaaccctgtttgttctggtgaacaattcagatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcc

SEQ ID NO: 12833 - DNA, 2146 bp, Homo sapiens
  ENST00000432271
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12834 - DNA, 702 bp, Homo sapiens; identical to SEQ ID NO: 12811
  ENST00000462016

SEQ ID NO: 12835 - DNA, 2503 bp, Homo sapiens
  ENST00000425145
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12836 - DNA, 774 bp, Homo sapiens; identical to SEQ ID NO: 12812
  ENST00000489187

SEQ ID NO: 12837 - DNA, 1587 bp, Homo sapiens
  ENST00000452233
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12838 - DNA, 1685 bp, Homo sapiens
  ENST00000427061
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12839 - DNA, 1568 bp, Homo sapiens
  ENST00000434177
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12840 - DNA, 1616 bp, Homo sapiens
  ENST00000430264
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12841 - DNA, 1866 bp, Homo sapiens
  ENST00000414889
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12842 - DNA, 1541 bp, Homo sapiens
  ENST00000442629
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12843 - DNA, 1730 bp, Homo sapiens
  ENST00000417635
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12844 - DNA, 1735 bp, Homo sapiens
  ENST00000470893
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12845 - DNA, 1985 bp, Homo sapiens
  ENST00000497074
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttctaa

SEQ ID NO: 12846 - DNA, 2045 bp, Homo sapiens
  ENST00000551175
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatatgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaataaaaaataataatacaagttttcataagcacacttct

SEQ ID NO: 12847 - DNA, 1587 bp, Homo sapiens
  ENST00000430351
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12848 - DNA, 1541 bp, Homo sapiens
  ENST00000428719
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12849 - DNA, 1685 bp, Homo sapiens
  ENST00000418693
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12850 - DNA, 1730 bp, Homo sapiens
  ENST00000450851
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12851 - DNA, 1568 bp, Homo sapiens
  ENST00000420045
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12852 - DNA, 1616 bp, Homo sapiens
  ENST00000439634
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12853 - DNA, 2146 bp, Homo sapiens
  ENST00000417019
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12854 - DNA, 1866 bp, Homo sapiens
  ENST00000415546
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12855 - DNA, 2503 bp, Homo sapiens
  ENST00000449096
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12856 - DNA, 1735 bp, Homo sapiens
  ENST00000494200
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12857 - DNA, 1985 bp, Homo sapiens
  ENST00000477504
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaa

SEQ ID NO: 12858 - DNA, 702 bp, Homo sapiens; identical to SEQ ID NO: 12811
  ENST00000476989

SEQ ID NO: 12859 - DNA, 774 bp, Homo sapiens; identical to SEQ ID NO: 12812
  ENST00000477366

SEQ ID NO: 12860 - DNA, 2045 bp, Homo sapiens
  ENST00000548017
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttct

SEQ ID NO: 12861 - DNA, 702 bp, Homo sapiens; identical to SEQ ID NO: 12811
  ENST00000488730

SEQ ID NO: 12862 - DNA, 2087 bp, Homo sapiens
  ENST00000383525
caattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12863 - DNA, 2507 bp, Homo sapiens
  ENST00000439884
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12864 - DNA, 774 bp, Homo sapiens; identical to SEQ ID NO: 12812
  ENST00000473784

SEQ ID NO: 12865 - DNA, 1591 bp, Homo sapiens
  ENST00000383521
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12866 - DNA, 1572 bp, Homo sapiens
  ENST00000400671
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12867 - DNA, 1689 bp, Homo sapiens
  ENST00000444952
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12868 - DNA, 1620 bp, Homo sapiens
  ENST00000400669
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12869 - DNA, 1870 bp, Homo sapiens
  ENST00000412760
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12870 - DNA, 1545 bp, Homo sapiens
  ENST00000448816
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12871 - DNA, 1734 bp, Homo sapiens
  ENST00000421858
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12872 - DNA, 1739 bp, Homo sapiens
  ENST00000479627
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12873 - DNA, 1989 bp, Homo sapiens
  ENST00000494392
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttctaa

SEQ ID NO: 12874 - DNA, 2049 bp, Homo sapiens
  ENST00000550849
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataataatacaagttttcataagcacacttct

SEQ ID NO: 12875 - DNA, 2142 bp, Homo sapiens
  ENST00000427289
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12876 - DNA, 702 bp, Homo sapiens; identical to SEQ ID NO: 12811
  ENST00000482220

SEQ ID NO: 12877 - DNA, 2499 bp, Homo sapiens
  ENST00000423895
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12878 - DNA, 774 bp, Homo sapiens; identical to SEQ ID NO: 12812
  ENST00000472743

SEQ ID NO: 12879 - DNA, 1583 bp, Homo sapiens
  ENST00000426782
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12880 - DNA, 1681 bp, Homo sapiens
  ENST00000421125
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12881 - DNA, 1564 bp, Homo sapiens
  ENST00000440561
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12882 - DNA, 1612 bp, Homo sapiens
  ENST00000457626
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12883 - DNA, 1862 bp, Homo sapiens
  ENST00000444674
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12884 - DNA, 1537 bp, Homo sapiens
  ENST00000458179
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12885 - DNA, 1726 bp, Homo sapiens
  ENST00000440073
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12886 - DNA, 1731 bp, Homo sapiens
  ENST00000493966
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12887 - DNA, 1981 bp, Homo sapiens
  ENST00000478704
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttctaa

SEQ ID NO: 12888 - DNA, 2041 bp, Homo sapiens
  ENST00000551993
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcgagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccagagtgacagagtaagactctgtctcaaaaataaataaataaataaataaataaataaataaataaataaataaaaaataataatacaagttttcataagcacacttct

SEQ ID NO: 12889 - DNA, 1579 bp, Homo sapiens
  ENST00000411455
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12890 - DNA, 1533 bp, Homo sapiens
  ENST00000434870
agcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12891 - DNA, 1677 bp, Homo sapiens
  ENST00000450634
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12892 - DNA, 1722 bp, Homo sapiens
  ENST00000431084
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12893 - DNA, 1560 bp, Homo sapiens
  ENST00000453271
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12894 - DNA, 1608 bp, Homo sapiens
  ENST00000459677
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12895 - DNA, 2138 bp, Homo sapiens
  ENST00000452744
agcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12896 - DNA, 1858 bp, Homo sapiens
  ENST00000400668
atggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12897 - DNA, 2495 bp, Homo sapiens
  ENST00000429153
agcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12898 - DNA, 1727 bp, Homo sapiens
  ENST00000495495
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12899 - DNA, 1977 bp, Homo sapiens
  ENST00000497130
ggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaaaaataataatacaagttttcataagcacacttctaa

SEQ ID NO: 12900 - DNA, 702 bp, Homo sapiens
  ENST00000425569
gggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactcttggcctcgtcttcctctgcctgcagtacagact

SEQ ID NO: 12901 - DNA, 774 bp, Homo sapiens; identical to SEQ ID NO: 12812
  ENST00000495080

SEQ ID NO: 12902 - DNA, 390 bp, Homo sapiens
  ENST00000639922
atggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactcttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttc

SEQ ID NO: 12903 - DNA, 1541 bp, Homo sapiens; identical to SEQ ID NO: 12842
  ENST00000400691

SEQ ID NO: 12904 - DNA, 1616 bp, Homo sapiens; identical to SEQ ID NO: 12840
  ENST00000383631

SEQ ID NO: 12905 - DNA, 1568 bp, Homo sapiens; identical to SEQ ID NO: 12839
  ENST00000359539

SEQ ID NO: 12906 - DNA, 1730 bp, Homo sapiens; identical to SEQ ID NO: 12843
  ENST00000400687

SEQ ID NO: 12907 - DNA, 1587 bp, Homo sapiens; identical to SEQ ID NO: 12837
  ENST00000400688

SEQ ID NO: 12908 - DNA, 2146 bp, Homo sapiens; identical to SEQ ID NO: 12833
  ENST00000383630

SEQ ID NO: 12909 - DNA, 2503 bp, Homo sapiens; identical to SEQ ID NO: 12835
  ENST00000259891

SEQ ID NO: 12910 - DNA, 1685 bp, Homo sapiens; identical to SEQ ID NO: 12838
  ENST00000415631

SEQ ID NO: 12911 - DNA, 1866 bp, Homo sapiens; identical to SEQ ID NO: 12841
  ENST00000442444

SEQ ID NO: 12912 - DNA, 1735 bp, Homo sapiens; identical to SEQ ID NO: 12844
  ENST00000461235

SEQ ID NO: 12913 - DNA, 1985 bp, Homo sapiens; identical to SEQ ID NO: 12845
  ENST00000484234

SEQ ID NO: 12914 - DNA, 711 bp, Homo sapiens
  ENST00000492471
gggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggtac

SEQ ID NO: 12915 - DNA, 774 bp, Homo sapiens; identical to SEQ ID NO: 12812
  ENST00000465504

SEQ ID NO: 12916 - DNA, 2045 bp, Homo sapiens; identical to SEQ ID NO: 12846
  ENST00000547083

SEQ ID NO: 12917 - DNA, 1824 bp, Homo sapiens
  ENST00000360458
gaactttctggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaagt

SEQ ID NO: 12918 - DNA, 1828 bp, Homo sapiens
  ENST00000441076
cacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttc

SEQ ID NO: 12919 - DNA, 899 bp, Homo sapiens
  ENST00000434230
tatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgc

SEQ ID NO: 12920 - DNA, 849 bp, Homo sapiens
  ENST00000418819
gcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatgttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatat

SEQ ID NO: 12921 - DNA, 869 bp, Homo sapiens
  ENST00000442614
acctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaatt

SEQ ID NO: 12922 - DNA, 582 bp, Homo sapiens
  ENST00000492116
tttgctgggatttggcggcatctagtggcagactcgagaggtataaaccttactcacagaactttctggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttggtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtg

SEQ ID NO: 12923 - DNA, 562 bp, Homo sapiens
  ENST00000422355
ggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccc

SEQ ID NO: 12924 - DNA, 573 bp, Homo sapiens
  ENST00000474653
tttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcct

SEQ ID NO: 12925 - DNA, 370 bp, Homo sapiens
  ENST00000467755
ggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcag

SEQ ID NO: 12926 - DNA, 451 bp, Homo sapiens
  ENST00000498064
gattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcag

SEQ ID NO: 12927 - DNA, 326 bp, Homo sapiens
  ENST00000488331
agaaggtcagtgtgcttgcttggagatcaggacgcaaaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatct

SEQ ID NO: 12928 - DNA, 1983 bp, Homo sapiens
  ENST00000422154
ttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 12929 - DNA, 1965 bp, Homo sapiens
  ENST00000433176
aaaatcccagaatcccagggaccaaacagccaatcctttgctgggatttggcggcatctagtggcagactcgagaggtataaaccttactcacagaactttctggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 12930 - DNA, 1830 bp, Homo sapiens
  ENST00000451301
ttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 12931 - DNA, 717 bp, Homo sapiens
  ENST00000423833
aaaatgagaggggcctcctcaggaaagaagacagctggtccacagcagaaaaatcttgaatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtga

SEQ ID NO: 12932 - DNA, 1567 bp, Homo sapiens
  ENST00000262966
cggggcggggccgcgtgacgtgccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcagccagcca

SEQ ID NO: 12933 - DNA, 1475 bp, Homo sapiens
  ENST00000359935
aagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctgatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcagcc

SEQ ID NO: 12934 - DNA, 1611 bp, Homo sapiens
  ENST00000599840
ggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaa

SEQ ID NO: 12935 - DNA, 1547 bp, Homo sapiens
  ENST00000594716
agagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgaggtgccgatcccggtgcagagctgagccggggtgtgcactctcccgttcccagcccgggcactgccaattgtccccagctgccatgggctgcgggctggtgaggcttctctcactggtctgtgtccctgccagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctgga

SEQ ID NO: 12936 - DNA, 1578 bp, Homo sapiens
  ENST00000596722
ggcgggcccagcggggcggaggcgcggggcgcggggctgcaggggcgcggggctgcagagccgtggggcgagcggcctccctgcagcctctcgctgtccgcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaac

SEQ ID NO: 12937 - DNA, 1445 bp, Homo sapiens
  ENST00000597036
cggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgag

SEQ ID NO: 12938 - DNA, 379 bp, Homo sapiens
  ENST00000601877
agaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggtgtgtggcccaccctgtctaggggcaaggggctccggagcccagtcggtgggcagcgggcggggctcccctgcgtatcagctccatgagagctggggccttgtctgctttgtttgctactggtacactgtgggtgctcaataaatgtatgaaggag

SEQ ID NO: 12939 - DNA, 407 bp, Homo sapiens
  ENST00000594162
gacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcag

SEQ ID NO: 12940 - DNA, 982 bp, Homo sapiens
  ENST00000432190
cgcgcccaagcggcggcggcggcggcggctggaggaggaggaggaggaggaggaggaggaggagggcggctgaggcgcggctggctgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccgcagcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacag

SEQ ID NO: 12941 - DNA, 8452 bp, Homo sapiens
  ENST00000222644
ggctggctgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagcattttgtatatgttttgatttagtacccttgcctttttcatcaaaggaattttcaaatcattcactctaacattggtctcatattttcactgtgataatgaatattacttgaaatagttttgtaaagctgtcatttagttcagtattcaaatagtgaagggttagtcttaatagaagaaaatatagttattgaccttccttcttataaatttcttacaaaagcagaattttaagtcagtgttatagctagtctactaccatctaaatctgacatcaaaagtctgatcagtttacgtattttcattatttcggagatgtatggctatccattctaatttatacagctatattagttttgtctcttcatttctatctttactgaaaaattgaagagcaataccttgcactctcttttgaggttattctttttatttgttgcagtgatatgatgctaactaatttaacatgtacacagtaagctctggggctggaagcaaggtcatgcagactgagagagtgccttatcctgtaaaaccttacagcaaaatgacacttgaagaaagtttattttcacatgtaaaattttgactgacaaaaggaacctactactttaaacaatggttttattagaacatggtcagcaaatgtatcatgcctctgcaaattttagtgatgtttagagatgcctctaagtttgcagttggaggtttttgtgcttttagaaatgtgatgtgatccttagggtacctgttttgtctgttgtgttgagaaccaaacccattgaacaacttaaaaaattgggaaataattgtcagctattttgtatacatacacacaaaatatatacattatataatatgtatattatgtattatataatatatataaaatgttttgtatattttttacatatctgttaaaaaatgtactttgtttttttgtttgtttgttttgagatggagtctctctctgtcacccatgctggagtacagtggcgcgatctcagcccgctgcaacctctgcctcctgggttcatgcgactctcgtgcctcagcctcccaagtaattgagattacagttgggtgccaccatgtccggctaatttttgtatttttagtacagatggggtttcaccatgttggccagggtggtctcgagctcctgacctcaagtgatccacccaccttggcctcccaaagtgctgagattacaagcatgagccactgcacctagccaagaagtgtactttttgtttaatgattaccgaaagaagttctcctttagaagcattgacttatacaaattcccacattcacctcagttaatatcttcctttaggattcttggataatagaaattcttcctaaaacatactcagagatgcagctcattattaaattaaggtaaccacattctgtattgttgctagcttttcatgtaaacattattcacactttaaaggattaggtgtttaaatattgatggtcatctttgtctggtgttaggtgccagacacctggctgctgaatttgttttttccctcaccaaagttgtcatttggaacgccagctgggaggactttgaaggaaaagaaaatatatgacaataggcagtattgacacattgtttaaaatctttttcacaataaaacaaaacacccaagttgtcatattgttaaagttggaaatctataggtttttctttttttttttttttttctttttttgattctagatttcatggccagaacacaaattcacgtttcttgtcctaggacagggaattggtgacaaaatggattatactattttaataacagtggaaactttcaaactacatgtgtttacaccaaattcttggcttctcaaagcaacatgaattaaagcacagtatcaaggtgatgccctatgacaatgtttcaacacacacttgaaattttaagagaaatttcagttcttcactcaggaaatgtgctgtattctctaatgtactttcatgctgcagcatggagcctctttaaacagctttgggataattatagcagcacaagaagtttatctgcaaaatatttcaatcatcttggtacaatagatgacttttacatcatgtatattagccttatgtgatataaaatgtattacttagaaaatatacttaaaggaattatttctattataaatggtattcatgattgactacttaattaatgcacattagatttctcctaatataaaatgaaatgatgcagtttagttcatttcagtctagatgcccgtactaacaagaatacagttagataagttcattgtatctcaatgaagaatcattgaacttgaaacccaagtcccaaatgaatctgcaggaatgagcagtgctctgcgggggcaaacagccccagaggtcccagggttcttcctaggtaatgagagtatagctgtgatcaaggaaatgtgaacttctcttttgggaagatctgcgataattagctttatggaagcgaaaatggtttagagtggtgttgagcaattgttaagagttgaaatagacacacacatgcatgtgcttttgggaaacatgatgtgccaacgtattaatgtgcctgagggctccttgtggataggtcagtgtccacatttcagcactcagggcatgactgtacacaacctaagactatatatatattttttcattttcaaatgtacaaatacccatagaggtgatgtgcctggataagtcatttaaccatagcttagtgaaataaatgtgatggccctaaaaagtagaattttcactttcattacagccatgcctttattatgcagtctccatttctgtgtgatatttggtaatatcacatgtcaaatacatcaggactttgtttattttggctaactctaactatacaattgctgaacatagctttctgaaatagaaattataagagaaacccagtatgcctacagcattagtagcctaaatcctagattctagaatccaataaatttatagtagttcttaagaagtttcctttaaagcaacaaatagattattaaggcaaatttagataataacccaagttagcaataaaaccatgtgacattatagattatgtccagatactaactgctttgaccataatatcccaatgacaataaaaaatgatccttggtttaaaaattattaaatggtacttatttttatgtataacaagtgtcatgatcccagtgactggagttgattttcaaggtggatagccatagagttaggtaaaattattttgaattggcaaactaaagataacaattttgaaaattgctcaaaataataatctacttaaattttacttttgtaacttctgaaacagtactccattatccagaaatcacaggctagagagccaataattttgtagtaatgaaccttaactaaacatgaaaaaggcaatcctgaagttttatgtacatagatagcagttcattttttaaatgttcgagttgccatatattatgtatgtgtgtgtgtgtgtgtatatatatatatatatatatatatatatatatatatatacagctatgtgtataatatgtaaaattctcccaaaatgtatgaatataaaactgaatgtattcattcatgtaattataactagcattctaaaatttttaattactcccatttctttgacattctgaaactttttttagattgttttaaaacgctctggttccaccttgaagctgataatctttctgaaaaatatatgagaaactcagaaagtagtcattattataataaatttaattttcttagggaaaaagggcagggttctggatggaaacccctttggaaattcttatttaaacttttgaatgaatctttaatatgattcaggctgagattatgatacctgcccttgtcttatttcaagaggtttgctgtgagaattcatgtaataacatctgtaatgtatttggaatttttgggagaaattcattcttttaaataatgggattattgtatatagtacaaatgaatactcacaaaatttaagaatacatttgactaataattgagcatcttgtcagtttttatgcaagcatatattgtatacctgaggaagatgacagttctataatttttttaaggtaaggttatttttaaattgcatttttgttctaacgttttgcaatttatattctttttaaaatatttcccataattcatcatgctagcttctgtgttcttggaatagtttttgaaaaatgcagagattcgaacatgagtccttaatatactaaacagtgaaagaatgatgatatctcatttctaaagtaagcatggttcacaccactttggcaatacactgcagtactttttaaaaaatattctctagtgataaaagtaaagacagggtactggccaagatcctaattctgacttctgactgtgtgatcttcgatgaaatttatatttccctttatcattactattctacttgttaagtaaggctaagttaatatttgtcttcgccttaaattctgatttgtaatttgtaactctgatgtggtagctgtgatatggtgaactgaaaaatccttattaggctactttatctgttctcttttagttattttaaagtgtacctgtttctgaagtaatgtagtgaatggtgaatacttttcaggaattcttccagttttaaaatagccccaaagatacagtttcagctggtggaaggtctgttctgctctcttagtcctaatcagaaagtcccttttatcttataatcccatactaaatccaaacccttagcaaatccttgctgccaaccagaccactcacaaatcaaacaaaatgtaagcaagcaatccagtactcggttacaccagaagactctgatctttgcccccgaaaactgtcctactttatccttatacctgaaatcactgcatacctgaaatcactgcagccctactgttttacccataccattaatttaaaaaggcatctatttctttatagaaagaaacattcacagtgaggtcttagtttgtgaacctcaaaatccagatattaatccactttagttattactttgtaattgcttctcagtcattggctgataatgcaatggtgtgataaatttgacttatctccacatacaaaagtcgatcagaagggatagttctcttcctttttttcccctcctactggctcttactgttttctaatctccagtgtaaatggaatgaacacatctatagttaaggtaaatgccaccaatcagaagattgagtgatttactgcttgtaaagcaactgtctttgaatcttatgaaataggtggtgttgctaccacagaagccaaaaaggtcttaaaattggaaatagatgtctttattgtacttcagccaacagcaagccaggggaaggaacatacataaatatgacaggtcatatatgaaatttggctctcctcctatcaaagtagcctaggagcttggaggaagcctaattaactaaaacaggaaaaaagcatactcatctgatgtaaaaactcatcagctgtaaattaccaacattaaaccagaagtcattaccagttaaaatgtgtggttttcatcttattcttaaataggagaggtggacagtagtgtaagtaacattgctttaaagacataaagcttgtcctggtaaacatggtctaaatgagaaatgcctccatcttttcaggtagaaccagatttcaggcatagctcagctacatctgtatttgaaatacaataaaaatatttcttatgtctctgtattctcttttaaaaagaactgctgactggctcctgtctcttcagtaacactgatttttttttaaagaagtgatatgttggactctgttgtagaagaatgagcactagtattcagcaacaagtgcaatttctccatgttatgttgagctctgttggagcctatggtgagtatttgatgtgaaaaccttgctgtgggaattttttattcttccttttccccccacgccagttcgttttggtaagtcttttatttgaacacaagacgcatgcttttttaaacctctagtttttgaagtaactgtagaagagaatctttaaaaaaaaaaatggagggcagaatgcttgttagcaatctgaaaatcaaagctgaacaagctgcttaaagtttctgattaagaagtttaaaaagaaaaattaattgctactgctttccaggtaattgtattattagtttctgtataaaagaaacattattgctgttgtataaataaaattttcctgtggtacaa

SEQ ID NO: 12942 - DNA, 1703 bp, Homo sapiens
  ENST00000409761
gggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaac

SEQ ID NO: 12943 - DNA, 3848 bp, Homo sapiens
  ENST00000396475
caactacgagccacgagtttgcagatggggctgctcggcggcgcctgtggctgagggagagcagcggcggcggggagcgaccgggagcggcggcagcggcggcgcggaggcggctgaggtgcgagccggactaaatcattttgctactttaaaaaaatcacgaaagtacattatttgaagtttggagaagaaagggatttggtaacaaaggacagccatttccattttaagcagctaaacagcaggagagatttctgtaagaaggtaccagctcagattccattgttcatcattttgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagcattttgtatatgttttgatttagtacccttgcctttttcatcaaaggaattttcaaatcattcactctaacattggtctcatattttcactgtgataatgaatattacttgaaatagttttgtaaagctgtcatttagttcagtattcaaatagtgaagggttagtcttaatagaagaaaatatagttattgaccttccttcttataaatttcttacaaaagcagaattttaagtcagtgttatagctagtctactaccatctaaatctgacatcaaaagtctgatcagtttacgtattttcattatttcggagatgtatggctatccattctaatttatacagctatattagttttgtctcttcatttctatctttactgaaaaattgaagagcaataccttgcactctcttttgaggttattctttttatttgttgcagtgatatgatgctaactaatttaacatgtacacagtaagctctggggctggaagcaaggtcatgcagactgagagagtgccttatcctgtaaaaccttacagcaaaatgacacttgaagaaagtttattttcacatgtaaaattttgactgacaaaaggaacctactactttaaacaatggttttattagaacatggtcagcaaatgtatcatgcctctgcaaattttagtgatgtttagagatgcctctaagtttgcagttggaggtttttgtgcttttagaaatgtgatgtgatccttagggtacctgttttgtctgttgtgttgagaaccaaacccattgaacaacttaaaaaattgggaaataattgtcagctattttgtatacatacacacaaaatatatacattatataatatgtatattatgtattatataatatatataaaatgttttgtatattttttacatatctgttaaaaaatgtactttgtttttttgtttgtttgttttgagatggagtctctctctgtcacccatgctggagtacagtggcgcgatctcagcccgctgcaacctctgcctcctgggttcatgcgactctcgtgcctcagcctcccaagtaattgagattacagttgggtgccaccatgtccggctaatttttgtatttttagtacagatggggtttcaccatgttggccagggtggtctcgagctcctgacctcaagtgatccacccaccttggcctcccaaagtgctgagattacaagcatgagccactgcacctagccaagaagtgtactttttgtttaatgattaccgaaagaagttctcctttagaagcattgacttatacaaattcccacattcacctcagttaatatcttcctttaggattcttggataatagaaattcttcctaaaacatactcagagatgcagctcattattaaattaaggtaaccacattctgtattgttgctagcttttcatgtaaacattattcacactttaaaggattaggtgtttaaatattgatggtcatctttgtctggtgttaggtgccagacacctggctgctgaatttgttttttccctcaccaaagttgtcatttggaacgccagctgggaggactttgaaggaaaagaaaatatatgacaataggcagtattgacacattgtttaaaatctttttcacaataaaacaaaacacccaa

SEQ ID NO: 12944 - DNA, 1191 bp, Homo sapiens
  ENST00000430180
gggagtcgcggtggagcctgaatggagagccggcctgggggcggcgttgctgtgactgacacctccggggtctgtcccgagagggggtgattccgccggctcccggttctctcccgagctcggagttggtaggggaggaggctttctccaactaccgccgctacttccgaggtacgagactccagttgtttggccaaagtggctgtgggccgagcacaggctgccgcgggggcgttcgctgctgagatcgtgctcgcggattctcgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaa

SEQ ID NO: 12945 - DNA, 552 bp, Homo sapiens
  ENST00000426450
caaaatggtaaattaaaggcaccatctttgggactccctggggaaaaacgtaaagaaggcagttgaagaaaggactaaatcattttgctactttaaaaaaatcacgaaagtacattatttgaagtttggagaagaaagggatttggtaacaaaggacagccatttccattttaagcagctaaacagcaggagagatttctgtaagaaggtaccagctcagattccattgttcatcattttgcaatgcagcaagtcttggaaaaccttacggagctgccctcgtctactggagcagaagaaatagacctaattttcctcaagggaattatggagaatcctattgtaaaatcacttgctaagggcctgtgaaaaagatcctgatcctatttccattttcaacaatggcaaagtactgattttcttcttttgcattagactgtgtacctacttttcatgctcatgagaggctagaagattccaaactagaagctgtcagtgacaataacttggaattagtcaatgaaattcttgaagacatcactcctctaataa

SEQ ID NO: 12946 - DNA, 374 bp, Homo sapiens
  ENST00000472674
tgaagtactaaatacattgtcagttacaattaaatcagagtggtttgacaaggattttttaaattcagtggcaagtgatacaactatagtatttttaattgtgctatgtgttttaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagc

SEQ ID NO: 12947 - DNA, 1125 bp, Homo sapiens
  ENST00000464384
ttcaggacctttttgtggaactataagtagcaaaaaaaagaaaaagatgatgtatctcacaaccagaaatgcagttgcagaggatgacagaaataaaaaacagctctatgaatcagaaatttctggaggcttaatcaaaggagttggcaattttaaaagtactttcttgacttcagagctacctctatgctgaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaa

SEQ ID NO: 12948 - DNA, 126 bp, Homo sapiens
  ENST00000625307
atgcagcaagtcttggaaaaccttacggagctgccctcgtctactggagcagaagaaatagacctaattttcctcaagggaattatggagaatcctattgtaaaatcacttgctaagggcctgtga

SEQ ID NO: 12949 - DNA, 5063 bp, Homo sapiens
  ENST00000375732
aatggaactaacaggaaccacctgtgcacttccttttacaggaatgttcataaacagcaggttctcctaggctttgaacaaaatttagcttctccaaggccaaaagcctcattgtgaagagaaagaaagaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaagagaaatttccataattgtctttttctatagagtgcatgatgaaatcaattacagttttggtagtagggtttttaaatctatatcactgtcatagatgtacaatcttggttcaagttgaatgctggttttgtttgtatctttttacagccttatttcaaacgccatgtgttagtataagatccgaaatcaaaatatgcacagtactgtattctaagcaaaacctcaaaccttctcgttgtcttcaataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaaataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcacccaaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacggggctattcataaaataaactgattgtatgtcaagatgtcctaatttaaaagagtagttttataaatcatggtcaacattccatgtaaatatttgagctttacaaagatagatccaagtgtgcgatctgtgcactgcacatttgatagcattattcactggttttccttcatacttgtcaagttcatattagaagcagagacaaaaaccactccaatggccttgacacatagtcacaccaaaatagataatcagactaagtattatataacaacgtgatccagacagtgagttctaagtgtattaattaaatagcaaaaaattttgtttttaaaaaatgaaagagggagggttgccaacctgaagtcttaagtagattgtttgggtagcatatttccttctttgaacattgtctgaaattttctataaatcaagacttcttgtacaaagaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaattcatatatttaaaaatcaagaccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgtacttacttgaaaattgtttttgcacttggatattctattttattatactactattgtgatctattccattatactatttcccatggtagaacaaattatattttctactgtgatatgaagtgatgtaattgaacttgccatgtctaaaattaaatttcatatttttttcaatcaaa

SEQ ID NO: 12950 - DNA, 4895 bp, Homo sapiens
  ENST00000496637
agaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtatgtggacatttttgagaattttcatgtgactgttttttataagcacatgcctgtcccgttttagacaactgagagttctccatttgaagtgtattttaattatcataataatatttgaaacagatgaaaaggtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaagagaaatttccataattgtctttttctatagagtgcatgatgaaatcaattacagttttggtagtagggtttttaaatctatatcactgtcatagatgtacaatcttggttcaagttgaatgctggttttgtttgtatctttttacagccttatttcaaacgccatgtgttagtataagatccgaaatcaaaatatgcacagtactgtattctaagcaaaacctcaaaccttctcgttgtcttcaataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaaataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcacccaaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacggggctattcataaaataaactgattgtatgtcaagatgtcctaatttaaaagagtagttttataaatcatggtcaacattccatgtaaatatttgagctttacaaagatagatccaagtgtgcgatctgtgcactgcacatttgatagcattattcactggttttccttcatacttgtcaagttcatattagaagcagagacaaaaaccactccaatggccttgacacatagtcacaccaaaatagataatcagactaagtattatataacaacgtgatccagacagtgagttctaagtgtattaattaaatagcaaaaaattttgtttttaaaaaatgaaagagggagggttgccaacctgaagtcttaagtagattgtttgggtagcatatttccttctttgaacattgtctgaaattttctataaatcaagacttcttgtacaaagaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaattcatatatttaaaaatcaagaccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgta

SEQ ID NO: 12951 - DNA, 2090 bp, Homo sapiens
  ENST00000375719
ataaacagcaggttctcctaggctttgaacaaaatttagcttctccaaggccaaaagcctcattgtgaagagaaagaaaggtatagcagtcttggcagttgctgaactgaattcctggctgatttccttactgcataaactcaactgctctcactgaggtcgtcattaagtcctgtgtgtgtttgggcaggccgacttgatttacagccagcactccactgcggaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaa

SEQ ID NO: 12952 - DNA, 1210 bp, Homo sapiens
  ENST00000441595
gcaaaacagtagcttcactcagacaccgtaaccatcatctcatcctggatgcaattgctgtggttaacacaggaagaaaaggagaagtatcactctttttgctgcacaaatgtgaaaactcacaataaagagaagggagaaagaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggca

SEQ ID NO: 12953 - DNA, 843 bp, Homo sapiens
  ENST00000481244
cttttacaggaatgttcataaacagcaggttctcctaggctttgaacaaaatttagcttctccaaggccaaaagcctcattgtgaagagaaagaaaggtatagcagtcttggcagttgctgaactgaattcctggctgaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggatac

SEQ ID NO: 12954 - DNA, 832 bp, Homo sapiens
  ENST00000474731
caacagtcccatgtgttgtaggtcccaggaggtcttggtgtttttgtagacagcagacaagaaataaaaggaattttgtcctttttacctcatgtaatcccactggaaaatgaaacatgtgctatgagttgatattgactcctgccaggtcacctccctaaagagtctcgggcaggcactgttgcaacatttcttggacaggagtgtgacgggctgtgatggagatggatggtttatgtagtacgctaccgtggaacactgcactactgtctgcccctaggaagtggctagtgaggacgccacgagtaacccgcatctgttactttaactctttcagagggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtg

SEQ ID NO: 12955 - DNA, 472 bp, Homo sapiens
  ENST00000474682
acgtggctgcaggctgttgaattggaattccctgtggctgtccgaaggcagggtgtccggagagcggtgggctgacctgttcctacaccttgcatcatgccagctttgtcaacgggatctgggagtgacactggtttgagcaaagcacagaagacaagagtctctgcatttacagaagccgcaaagtacggcgtatgcatcagatgtttgcaactggccagtcgggtcatttttcccataagcagcgttgcttagcagtgtcgctgacgtcgtcccattagttccaggggaacagagttgaagtcagacccttgtgccacaggagcaaggcacccgactcacagcagcctagatgcatggattgctcatttgggaaaatacgttctgtgtaaaacttttaccacttcttctttcccttcttgcttatttcacgaagaaaaaaaaaactaattatacaagtaatacataaaaa

SEQ ID NO: 12956 - DNA, 5080 bp, Homo sapiens
  ENST00000337532
aggtatagcagtcttggcagttgctgaactgaattcctggctgatttccttactgcataaactcaactgctctcactgaggtcgtcattaagtcctgtgtgtgtttgggcaggccgacttgatttacagccagcactccactgcggaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaagagaaatttccataattgtctttttctatagagtgcatgatgaaatcaattacagttttggtagtagggtttttaaatctatatcactgtcatagatgtacaatcttggttcaagttgaatgctggttttgtttgtatctttttacagccttatttcaaacgccatgtgttagtataagatccgaaatcaaaatatgcacagtactgtattctaagcaaaacctcaaaccttctcgttgtcttcaataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaaataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcacccaaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacggggctattcataaaataaactgattgtatgtcaagatgtcctaatttaaaagagtagttttataaatcatggtcaacattccatgtaaatatttgagctttacaaagatagatccaagtgtgcgatctgtgcactgcacatttgatagcattattcactggttttccttcatacttgtcaagttcatattagaagcagagacaaaaaccactccaatggccttgacacatagtcacaccaaaatagataatcagactaagtattatataacaacgtgatccagacagtgagttctaagtgtattaattaaatagcaaaaaattttgtttttaaaaaatgaaagagggagggttgccaacctgaagtcttaagtagattgtttgggtagcatatttccttctttgaacattgtctgaaattttctataaatcaagacttcttgtacaaagaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaattcatatatttaaaaatcaagaccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgtacttacttgaaaattgtttttgcacttggatattctattttattatactactattgtgatctattccattatactatttcccatggtagaacaaattatattttctactgtgatatgaagtgatgtaattgaacttgccatgtctaaaattaaatttcatatttttttcaatcaaa

SEQ ID NO: 12957 - DNA, 3657 bp, Homo sapiens
  ENST00000417669
agcaaggcagggcctctttacactgggtgtcgcgccgtctgagttcctgacttgtttacccatcccgttggggctccggccgctgcaggctacctgctgtgcccgggattggggacctgtgactcccgagtggaagagatggtggcccaggaggaggaccccgacctattcagactgggagctggggtcagagtgtctccgtctccggagggggaccttccagaccccgggcgggaggggcccacagcagggtgccccggcggccccaggagggggtccgggcctcgggcgaaggctgcggcgccccggaaggagccgcgcacgcccctgcacgcggtgcccgctgcggaggccacggatccggagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacacagacagtccctttctctcctcccaagtgagggaggagacaggcccaaggcggaggccctccgagggagcatttagggacatctcaggaattcagaccgcacctggccaggcccacagctgtttgcctggcattgttcccccctttttcttcccataggcatttttgtttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggtgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagggggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgcattaaagtagtattatttgtcctgattggtgactttttttgcacccctttccgttgtacatctgagagaagggtgtcactccctcacccaggtcccagccctgggaaccagcctaccgtgagcccttttgcagatatagactcatttcatcctcagatggtccttcaaggtaggtactttagtcccattttagagatgagacgattgaggccagaggggtgtggtaacttgcctgggggctcacagcacaaaaggagccgaggcaggatctgacccttgttctctggcctcactgccctcactttgccatgacccgaagttatgtccctacaaagcaatgcatggtccaaggctctttttattgtatttttatttttaagggtcctgttcaaaactggtgtgagctctgaggagtcctgaaccctgggtgcagcatcctagcatcctgggagtccttttctgcccacactgagctgggctcctcgaggggtggggctgctgtccctggaagcctggcagcagcactgtatcgggttggctgaagctgagcgccgtggggtgcagggctccaggaatcccgtttggctgaaggggttcctgtagccagggatgtttatgaggtctctctgatgccccaggcgcaggacatgtgtgcgggtggagaaaagcaggccctttcagtgccagctccactcaatttctatgtggaccaagaacgataaacttaaaaaaatttttttcctaaggtatcttcagaatatggtgtatttttatgtggaaaagaaaagttatgaaggcagctgttactttaagagaaaattcattaaaagtcctcgaggtatgaagatgacggcgtgcttctcaatcattttggcataacttgattgtggctgtaatttttttttttttttttgtcaagcatgtcagacaataaagtctttgtaaaaagagaa

SEQ ID NO: 12958 - DNA, 582 bp, Homo sapiens
  ENST00000334209
cacttgcagcctcggacgcgcggcgaggcggccgccgccggaggagcccccgcccctgcgcgcctccctcccgggagcccctgcctccctcggtgcgcgctgctgctcgcagccgccgcggccgccgaagaggagcccggggccagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttca

SEQ ID NO: 12959 - DNA, 728 bp, Homo sapiens
  ENST00000447567
aaattgtatttgaatcctgagcaaccacagccctctagcctcttcccctccctagccatatctgaacagcttcccatttcaactccatagatacgtgactctccaagtgctttattttgaaaactaggacgtagcactttgcagaagaaaaatcagtccacttgctattatttatgtgatcgctgatctgctagatggatatagaaagcaccaagaattataataatttatggagtagagcactggtttacaaacatatttctctgcccgagctttgtgtgtttctttgcgtctcggggctcgttctgtgcaatgggaatggagaatattcagaatttgaagacaagcccggcgagccgactgcattcatagctaaaattaaaggaataagtgagcagctatttgtggcagacaggacatgatccatctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagat

SEQ ID NO: 12960 - DNA, 1943 bp, Homo sapiens
  ENST00000465861
tgtggatatgtctgtgtgcatgtttgaaacagatctgaacagcttcccatttcaactccatagatacgtgactctccaagtgctttattttgaaaactaggacgtagcactttgcagaagaaaaatcagtccacttgctattatttatgtgatcgctgatctgctagatggatatagaaagcaccaagaattataataatttatggagtagagcactggtttacaaacatatttctctgcccgagctttgtgtgtttctttgcgtctcggggctcgttctgtgcaatgggaatggagaatattcagaatttgaagacaagcccggcgagccgactgcattcatagctaaaattaaaggaataagtgagcagctatttgtggcagacaggacatgatccaggaccacttaggaagggttagtgtggtttctctgtgacatttcgccacattgcaacaaaagccctagtaagcactgcctttgctgagccaagccggctttttctctgcatcgccctgagccaccggcctgaagacaggcagctgcacttttggctgtcccatcagagaggctggggctattcagtcgctcctactctcagttaaaggccccaagaggagacggagccaaggtgcgtctaggatcctggtgaaagctttccaaggtggggttcctcagaacgccgcagcggggatggctgttgggggagatgtttctctggaagcttctcatgcttaataagacagtcgtttctgtgtgctcattgactgtcatccgagttttggacccaggacagcaccatattatgctagccccccagtgattgttaaagagctgccgatgaatggaagagaaacacaggtgtgttctggggatggctgccttaccggcctggcactggctttgatcagagtgaccttttccttccaaacgagagcactttcgagagccggagaggatgctggtaatagtggcacagggacagcagatgtgaactggggctgtcctgggcctgcgctgagtttgagaggcctgtgttggctggaagtgatgcttcaagtcacacggtgaagcaaaatctatctttggtctgcagggcagcagctcctctggtagtgcaatcctccaagatcttcctcacacatcttcggacagagaggggccaccagaatgatccaagcatctcttttgcaaacattcatctgctgctgagatgctctgtgtgagccaaggcctctctctctctccttcctgggccttcagcacacactggctggcctcgctgtttggtgggggccttcttaggggcccacagaccccctccactgcaactcctcaaaatagagttctgaggaggtctgttttctgcctggctggttcgccgggtctgagcccttggagggctagtttcgtgtctgggtcctgtggctcccagaacaggatctggcccagagcaggagcagcagtgggtgcgttggggctgaccagtgccctgcagtgtccagatgggggtggtggtgaagaatttgcctagaaaaacgtgtcaagggtgggttgtagtggacgtgtccagccacaactccctgggaagtcaaagcctcagagtcttactcggtggggcgagaaggaaggggccaggcaccatgggctttcaggcaggagaggaggggttgcttgaaaatcccttctgcattcttgaaatttccctggggagcttctgagttcatcagaactttctaactagaggggaagagacatggagtgagcacctcctgtgtgctaggccctggcaggggcttttgaatctcctgtgtccttcagtgctccagcagcccaggaaggaaggattgagaatccacatgtttgtaggtgaaaaactaagattaaggggggcaaagctgcttttgagtcctgctgtcagactcaaaggcctgtgtagtttctc

SEQ ID NO: 12961 - DNA, 578 bp, Homo sapiens
  ENST00000480239
attatttatgtgatcgctgatctgctagatggatatagaaagcaccaagaattataataatttatggagtagagcactggtttacaaacatatttctctgcccgagctttgtgtgtttctttgcgtctcggggctcgttctgtgcaatgggaatggagaatattcagaatttgaagacaagcccggcgagccgactgcattcatagctaaaattaaaggaataagtgagcagctatttgtggcagacaggacatgatccatctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatgtaagtgggaccggtg

SEQ ID NO: 12962 - DNA, 2507 bp, Homo sapiens
  ENST00000443721
acttgcagcctcggacgcgcggcgaggcggccgccgccggaggagcccccgcccctgcgcgcctccctcccgggagcccctgcctccctcggtgcgcgctgctgctcgcagccgccgcggccgccgaagaggagcccggggccagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacacagacagtccctttctctcctcccaagtgagggaggagacaggcccaaggcggaggccctccgagggagcatttagggacatctcaggaattcagaccgcacctggccaggcccacagctgtttgcctggcattgttcccccctttttcttcccataggcatttttgtttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggtgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagggggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgcattaaagtagtattatttgtcctg

SEQ ID NO: 12963 - DNA, 1693 bp, Homo sapiens
  ENST00000463290
cactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 12964 - DNA, 1955 bp, Homo sapiens
  ENST00000533357
gttcagttcctggtcccccactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaa

SEQ ID NO: 12965 - DNA, 1824 bp, Homo sapiens
  ENST00000491222
cttactgggcccataggtgcatctgattccccactttgtgcttgcagtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacc

SEQ ID NO: 12966 - DNA, 957 bp, Homo sapiens
  ENST00000526189
aaccctacattgacgaggtggggaccttcaaagagcgcatccagtgggtaggggaccctcgctggaaggatggctccattgtcatacacaacctagactacagtgacaatgtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgttt

SEQ ID NO: 12967 - DNA, 878 bp, Homo sapiens
  ENST00000476410
tactgctggctacgcaggcaggcggccctgcagaggaggctcagtgctatggagaaggggaaattgcacaagccaggaaaggacgcgtcgaagcgcgggcggcaggttagcgggacttggggcctagacaagatgggaaggagaaccctgggagccgccgggcagcagtgaggggtgggatgggaacagtcaagccccagtcgctcggtgactgatgtgtgcgcccctcccccagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctgg

SEQ ID NO: 12968 - DNA, 366 bp, Homo sapiens
  ENST00000488271
acagcagtctctcttcttgcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaact

SEQ ID NO: 12969 - DNA, 2153 bp, Homo sapiens
  ENST00000257776
ctcggatctaggagctactcgcccggccctgggcggtgggaggcggcggcggcggcggcgctcgcgcacctcggaggagccaggagccggaaccagggccgagcccgcgggccggggctagccagccggtcggagatgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgttttttgtgctgaccttgctgaccaagacaggagccccacaccaagacaatgcagagtcctcagagaagagattcagaatgaacagctttgtgtcagactttggaagacctctggagccagataaagtattttctcgccaaggcaacgaggagtccaggtctctctttcactgctacatcaatgaggtggaacgcttggacagagccaaagcttgtcaccagaccacagcccttgacagtgacgtccaactccaggaagccatcagaagcagtgggcagccagaggaggagctgaacaggctcatgaagtttgacatccccaactttgtgaacacagaccagaactactttggggaggatgatcttctgatttctgaaccacctattgttctggaaactaagccactttcccagacctcacacaaagacctggattgagaaacatgctctgtaaagggtcttcctgaagatgtggattctatctttatgtagcaagaaatctacatccaccaaaattgtgtgtgtttgggggagagagagacatagagatagagacagagaggcagagaagagacccctttagaagagagctgagctgattaagctgagtggttttttgttttgttttgtttttgctttttaatacatttggagctttgggagtattaaagtatttacaccaagcttgtccaacccgtggcatgtgtcccaggacagctttgaatgtggcccaatacaaattttaaactttattaaaacatgagttttgtttttttttttgctattttttttaaagctcgtcagctatcgttagtgttagtgtactttatgtgtggcccaagacaactcttcttccagtgtggcacagggaagctaaaagattggacacctctgatttatactagctcgttttgcttgttgaaaaatttggccaaatacctattgtcagcattcttgggtgaggattagcctaccatgttctaatctggccctgccactactatgctctacctttggtgagttgctttacctctctgggctgccccatttttaactgtaggttgacaggtctagagtgatccatcccacctctaatattttgtgaatttatgactttgccttcagatgaggctgagctatacataaaacagtataaactagggtactgcctcgtatctcttgtaggctctctcaaatctctgtaccttccacttaaccctaattgagccaagctttagtcaggggatctggttgtctaccagaatgtcaggagactcatcttacacagtcatggtggccaatgtttctggtgggttgtgctgaaacagctcttctgagaacttccaaccacccatgctctaacctggagacagccatcccctgcctcagaataagtaccaattcgtagtacatgtatggtactcttgtccccaagaaatgttaggaagcttgtcagctgaatgagaggaggtgccttctgggtatctctgtgttggtgtatctgtgccattggctacagaacaagaaaaatactatttgccatgctattaccttggcagatgtgtaggtgatagtcatctggctttgagctgagatggtcagtgggttgtaaattccccactagcagatattcagggtggcctgagttatgtaaacaagtgagcaacacagctttaatttcatggaggaatcaaagctgcacactggtattaaaacaacttgattttgcgcacacagttgcatgcatggcaagctgttaacctctgggtggcattttcattatgaatttgttcaccacctgtcttgcttaagctacaaaataaatgcatttgactgca

SEQ ID NO: 12970 - DNA, 2295 bp, Homo sapiens
  ENST00000309099
gatgagttcccggtggggctctggggggggctcctgagcggggcattccttcctgaagcctcatccccgctcagccctgctcagcccctcctcctactcccctccccctccccctcctgccgggccaggaattgggtttggggcgggttctgcttccaaagccatctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccagcgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagaccctgtggcccctgcccggctcccccacccattctgctcccctagagacctcttgtacagaagttgcccccaggtggtggggcccctccttgccctaggctggttggtaaaagagaggaggtcaacacccagcctagccacctctgcctcttgggtcagccctccttgactgtgtcccagccagcaccaggccagcagcctcatccctgccattcagggctgttccagagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaagggcctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgca

SEQ ID NO: 12971 - DNA, 705 bp, Homo sapiens
  ENST00000320913
atctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaaggtaagtgccacaggcggagggccctggtcttgcccagacgggtgtgggtgggaggggcagacccagcccagcatctcctcccccatcccccccttcctggccccactttccagctctggacccaccgtgggcagtgggctcctctgggctatgtggccgggcacaagttccctggaccctcctaccctcctgtcctcatcagtgaggcaagcaccaggactggacctcaaggtccctcgctgtgctgacactgtggtcgccttgtagcatccttgcaaggtcttgtttcatctcttccctgcagaggtggggcagtcagctacttactacagccaggcgggccaggaagccctgggacgctgactccaaggtggccctgatgtcatgtgctccatggagcctagggggtcctgggccaccccgagagtgttgcccca

SEQ ID NO: 12972 - DNA, 2282 bp, Homo sapiens
  ENST00000441623
gggctcctgagcggggcattccttcctgaagcctcatccccgctcagccctgctcagcccctcctcctactcccctccccctccccctcctgccgggccaggaattgggtttggggcgggttctgcttccaaagccatctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggcttctgccaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccagcgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagaccctgtggcccctgcccggctcccccacccattctgctcccctagagacctcttgtacagaagttgcccccaggtggtggggcccctccttgccctaggctggttggtaaaagagaggaggtcaacacccagcctagccacctctgcctcttgggtcagccctccttgactgtgtcccagccagcaccaggccagcagcctcatccctgccattcagggctgttccagagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaagggcctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgcagcc

SEQ ID NO: 12973 - DNA, 644 bp, Homo sapiens
  ENST00000628562
atttgacacaggaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaacttgttgagtgactcacattttatgacattgccaatttattctagaagccaacaggacactgcaatacaaacaacattgtgtattgtttagttctttatggtttatgaaacattcacatatactgaagtgaatttttttccccaaaaacatctatcctactgagtcatgaaacttctagatttttagccaggtgtggtggctcacacctgtaatcccagcactttgagaggcccaggtaggcggatcccttgagtgcaggagttcgatacgggcctgagcaacctgaagaaatcccatctcta

SEQ ID NO: 12974 - DNA, 495 bp, Homo sapiens
  ENST00000430431
tcattcccttgactttggacttcgcttattgaacccctggacaacggaatctccctctgtcgcccaggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaa

SEQ ID NO: 12975 - DNA, 422 bp, Homo sapiens
  ENST00000414264
gcctcctgatccaccaagaccatatggtgtttttcataaaagagagagatcattcccttgactttggacttcgcttattgaacccctggacagaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaa

SEQ ID NO: 12976 - DNA, 520 bp, Homo sapiens
  ENST00000594536
gcctcctgatccaccaagaccatatggtgtttttcataaaagagagagatcattcccttgactttggacttcgcttattgaacccctggacagctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaa

SEQ ID NO: 12977 - DNA, 421 bp, Homo sapiens
  ENST00000598384
actgagggatgactgtacttaaaaaataggcacacaatctcatgagttatggtcacttacatacgaaggcttttctggttgtaattgttgttttgtcatgaagatattaaagccttggtttcagacaatttttagggaattatttcttttcttttctttttttttttttgagacggaatctccctctgtcgcccaggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatg

SEQ ID NO: 12978 - DNA, 870 bp, Homo sapiens
  ENST00000600486
aatccctcatgggtactgagggatgactgtacttaaaaaataggcacacaatctcatgagttatggtcacttacatacgaaggcttttctggttgtaattgttgttttgtcatgaagatattaaagccttggtttcagacaatttttagggaattatttcttttcttttctttttttttttttgagacggaatctccctctgtcgcccaggctggagtgcagtggcaccatctcggcttaccgcaacctccgcctcctgggttcaaacaatactcctaccttggcctcctgagtagctgggattacaggtgagcaccaccatgcccggctaattttttttgtacttttagtagagacggggtttcaccatattggtcaggctggtctcgaactcctgaccttgtgatctgcccgctttggccttccaaagtgctgggattacaggcgtgagccaccgtgcccggtcgggaattacttctttaaaaagtgtggtgaatgtttgccccaccaggaaaatcctagaatttagcttaatctttctgtccaatgttcagttttaagctctacaattctgggataaacagaaattaaagtgtcatattttcaaaagttcactcttagacatctccttccaatctagttttgaaaacaattttagaagtttttctgtgtaggctccctgcccctccacttcctacactacctcactgtccagtaaaactttttgctatgatttgacacaggaatcaaggttgctaagagaccacctgtgctgaatacactttgttctggcaagagcagaaaactgagaagccgtgttacctaccactacctgggattaattcagggagcgggataattctggatatg

SEQ ID NO: 12979 - DNA, 286 bp, Homo sapiens
  ENST00000602051
acaatgggtggccgggcagagacgctcctcacttcctagacaggatgacggccgggaagaggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatg

SEQ ID NO: 12980 - DNA, 281 bp, Homo sapiens
  ENST00000599605
aatccatttaacccttagtggacacagaacatgtttcagagagcacggagttgggggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatg

SEQ ID NO: 12981 - DNA, 898 bp, Homo sapiens
  ENST00000612853
agggacttgagcatttatggattttggtatccatggttactgtatctgtggggtattctagaactaatccctcatgggtactgagggatgactgtacttaaaaaataggcacacaatctcatgagttatggtcacttacatacgaaggcttttctggttgtaattgttgttttgtcatgaagatattaaagccttggtttcagacaatttttagggaattatttcttttcttttctttttttttttttgagacggaatctccctctgtcgcccaggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcaggtgagaaatgggtctctactcactcctcattcctcactaattgtctattcccctcctcacttcttatttcagtctctctcttactctatttggagagagttgaaggtacccctgggagccacagactgaagaaacacaagctggagtttgaggtttctggagagaaggaaaatcactttgcaaacccgtgtattatttttgctccttgttgctgaaacacaggcaaaaggaattgttgcatgcagggaaaattctaggtgtttcttttgctaatgattattgtataatttggggcaagtaattcccttctctaggaatggagcaatttattacagaaattatcaagatagctcaaaatgggagtagacaacactggcagagtactcatttctttccccttctctttttcttattctctctt

SEQ ID NO: 12982 - DNA, 781 bp, Homo sapiens
  ENST00000621566
actccattttctaatttgtttgtaaaaatgatacaaaatactaaaacataatacagttggccctccagatccatgggttccatatccatggattcaaccaaccacagattgaaaatattttgaaaaaactatgtatctctattgcatatgtacagactttttttcttgtcattgttttgtatacaatacagcataacagctatttacatagcacttatattgtattaggtattataagtaacgtatggagatgatttacagcatatgggaggatatgtgtagtttatatgtaaatactatgccatttatatcagggacttgagcatttatggattttggtatccatggttactgtatctgtggggtattctagaactaatccctcatgggtactgagggatgactgtacttaaaaaataggcacacaatctcatgagttatggtcacttacatacgaaggcttttctggttgtaattgttgttttgtcatgaagatattaaagccttggtttcagacaatttttagggaattatttcttttcttttctttttttttttttgagacggaatctccctctgtcgcccaggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggat

SEQ ID NO: 12983 - DNA, 771 bp, Homo sapiens
  ENST00000629130
aaaaatactttttaaagtattagaacctcaattctaccaccaacagggtggcttaaaacaacagaaatttattgtgtcatttatggagaccagaagaccaagattaaggtatcggcaggaccatggcccctctgaaggctctgggggagggtctttctttgcctcttccttgcttctctggtggttgcccacagtccttggtattccttggcttgtggacacgtcactccaatatctatttcctttgtcacatgatgtctccctatgtgcctgactatgtccccatttcccacttctcacaaggactcaggtcattggattagggcccaccctaatccagcatgatctcattttgattatatcagcaaggccctatttccaaatagggtcacattcacaggtactgaggacttgggcttgaaaatgtctctaggggatgcagttcaacccacaacagctaataagtggtgggcctggtgttctgaacactcatcagtcagctgcagagtggagtgtccatgccccagggaccagtaaagatgacccattggaagtgtgacggaatctccctctgtcgcccaggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacct

SEQ ID NO: 12984 - DNA, 1819 bp, Homo sapiens
  ENST00000467199
atggcggggtgagctgggcgctgctgctgcgcgtgcagacagcgggagtggttgggggtccgcccggtcgccttcctcggtcctggcctcggggctgggtgccgagcgctgggcaccgtccccgcactcagcgagcgcgacaggggcgaggccaggattccgggtcgcagttccccgggaggagggcgccctcaggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagcaagcagtgatgtggtgtgtttattttcttttactcatctaggaacttgacgcagctttatat

SEQ ID NO: 12985 - DNA, 1601 bp, Homo sapiens
  ENST00000242257
gcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagcaa

SEQ ID NO: 12986 - DNA, 2511 bp, Homo sapiens
  ENST00000486040
tgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatggagtctcactcttgcccaggctgcagtgcaatggtgtgatctcggctcactgcaacctctgcctacctggttcaagcgattctcctgcctcagcctcccaagtagctgggattacaggcgcccgccaccgcacccagctaattttttctttttgtttttttaagtagagatagggtttcactatgttggctaggctgatctcgaactcttgacctcaggtgatctgcccacctcggcctcccaaagtgctgggattacagatgtgagccatggtgcccggctactcttaatgatgtattgacatctttccccaacagcacagctaaatttccaagtcgcataagccctggggctttcctggtggccccactggggctgctccgtccggaacctagaagaggcttcatggccagggctatggattctttgctctggatgaagctgagacacagttttcatctgttttgtatcttagggttttgagtaagattttctatataaaaaggttctcctgaataatgagatcagccaaccgcccatgcaactgaagacactgtcgtcattgggaaagtttcatcctattccatgtagtgcttgcaccgtaggttctttaaccagctccctcactgtggcatcaaggttgcttttggcttttggctgggatgcgtgtgctgtggtgaatatccttgccatttatgtttcctgctgtaaagccagggtagctgcatgcactggcatttgaacagggtgagacagtccacccagagctctcccaagtctctcccaaataccttagagtagggacactggtccccatttattggtgagaaaacaggctcagggtttcatgacttgttgaaagtgcagaaatggaatgctggccccctggatctgcacatctgcctcgctgctggtttgcgatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaa

SEQ ID NO: 12987 - DNA, 582 bp, Homo sapiens
  ENST00000407040
aatgaaagacaaggtagaaaggtgcagtgaacatggaaatcacctcgcatgagaccgcccgcagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagt

SEQ ID NO: 12988 - DNA, 1570 bp, Homo sapiens
  ENST00000440306
atggccgggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagc

SEQ ID NO: 12989 - DNA, 758 bp, Homo sapiens
  ENST00000476826
gctgggaagaggttgaaccttcgcctcaaacgatgttgcgcagacgcagtgggccattctagtgccttctagaaaagggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgccc

SEQ ID NO: 12990 - DNA, 600 bp, Homo sapiens
  ENST00000479638
aaggttgtaagaagggtggagcttggagctggggtgtaactggaggggcgggcccttctccaagttagagttggggttctgagcgagtcgtgcgttttaggtttagtgtcttttccttgtccctgctcggggagcgtgaggcagatcggccggctttgctccaggcctcaggagtctcactcgcctgggcttgcacagtacattggaacgtgcgggttctattttgtattcgacgtgccggatcgaaatagagctcgcggcactgcgaagaccacagtaggaagttaaggacgggggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtacc

SEQ ID NO: 12991 - DNA, 978 bp, Homo sapiens
  ENST00000367034
ggagagtttggggatctacagcagccaaaggcttgtccctgactttatatggctgctcctggcgagcgactgagtcgtccgtgaggaaaaagaggcgaggcttttccgagatcgtctcagcgatggcgcttcggtcgcggttttgggggttgttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctg

SEQ ID NO: 12992 - DNA, 1075 bp, Homo sapiens
  ENST00000480842
gctgctcctggcgagcgactgagtcgtccgtgaggaaaaagaggcgaggcttttccgagatcgtctcagcgatggcgcttcggtcgcggttttgggggttgttctcggtttgcaggaaccctggtaattagtcttgccccccttctcccagctcactcgcctgggcttgcacagtacattggaacgtgcgggttctattttgtattcgacgtgccggatcgaaatagagctcgcggcactgcgaagaccacagtaggaagttaaggacgggggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctg

SEQ ID NO: 12993 - DNA, 2975 bp, Homo sapiens
  ENST00000257552
cttcgccgcgctcctcatctgccccgcgccgagcgccgccgccgccgccgccgccgccgctccgctgcccgcgccgcccgcggctcccgatggagactgacgcgccccagcccggcctcgcctccccggactcgccgcacgacccctgcaagatgttcatcgggggactcagttggcagactacgcaggaagggctgcgcgaatacttcggccagttcggggaggtgaaggagtgtctggtgatgcgggaccccctgaccaagagatccaggggtttcggcttcgtcactttcatggaccaggcgggggtggataaagtgctggcgcaatcgcggcacgagctcgactccaaaacaattgaccctaaggtggccttccctcggcgagcacagcccaagatggtgactcgaacgaagaagatctttgtgggggggctgtcggtgaacaccacggtggaggacgtgaagcaatattttgagcagtttgggaaggtggacgacgccatgctgatgtttgacaaaaccaccaaccggcaccgagggttcgggtttgtcacgtttgagagtgaggacatcgtggagaaagtgtgtgaaattcattttcatgaaatcaacaacaaaatggtggaatgtaagaaagctcagccaaaggaggtgatgtcgccaacgggctcagcccgggggaggtctcgagtcatgccctacggaatggacgccttcatgctgggcatcggcatgctgggttacccaggtttccaagccacaacctacgccagccggagttatacaggcctcgcccctggctacacctaccagttccccgaattccgtgtagagcggacccctctcccgagcgccccagtcctccccgagcttacagccattcctctcactgcctacggaccaatggcggcggcagcggcggcagcggctgtggttcgagggacaggctctcacccctggacgatggctccccctccaggttcgactcccagccgcacagggggcttcctggggaccaccagccccggccccatggccgagctctacggggcggccaaccaggactcgggggtcagcagttacatcagcgccgccagccctgcccccagcaccggcttcggccacagtcttgggggccctttgattgccacagccttcaccaatgggtaccactgaagcaggggacggtggcaggagcgccccagcctgcagctgactgaggaccacgagtgagccagcgagggggcgggagacctcagccgcagccgccgccccctcccctgcagcgactcggacccgctactgcctgcccccaactccccgggcccggcccctgccctgctgcccccaacagcgtctggctcccctactaacgtccccctcttcgcccttgcccccatccccacccgcccctctcccggccctgcttttatttattttggattagccggttgcccaccccagccctctggtccatccctccctccgtgccgcgcccccctaggaccgccccctccccaaaaggcttttggatttgtgcatagctggagtgaaggcggagggagcctgctacaggccgcagcccaacccctgttttttattcagatttcccctcctttaccctttccctttttttttttttttttttttttaaagaaaccttttttaaactatttctaggtttgtgaatgtgaagccccaggccgcagggggcaaggggccaggtgccccccaccagctgagaacaaagtgtctatctgggtgtgggcccctggccgcctccctccagccctggagaggagggcagggctgcggggaggccaggccgagcccctggaaccatcccgtcctgtatcatatgtaaatactgtgaggtgatgtgcccacccctctctaagacccctcgggggtgaggggctcccccctcccctgtttctgtcccctcagacaccgttactgtaagcttgcaggcctcagctgtggccacggcaggcccgctctctcaggccctcagggtcaaggccttggttggacctgcccactccaaaaacccagtgtgggggcaaagggcgtgggaagagcagggcttgcccagcgacactgctggacaggaattaactctccaaaggtctcccctgctccctacctaggttggggcttcatggtttctgctcagtctgtcccccttccccctcgacccccgcaatgagtgggcaccaggggacgctctggcgagggcagaccccaggggaaagcaaagggcgtctcagggaacccccacattctctcactgaagtttcccaccaggatgaccccacagccagagtcccttggcagcccctcaccccagaccccccttctaaggaaaaagagaggttcagagcgttggaccttcatgaacagtggcctggctggcgtggcagggccaaggcccacccactgccatcccccttctgtgtgtccctctcccccagttatgaggcccagggcctgagctctcttccccagcattgcccccacccggaaaccccacctttggagagttaattgtctgtgtgaggtgcttaacctatcagccctgagaacacaaagcaataatctttgttactgagatgcgcggctgttcgtgttttgggttttttttttttttaatgtttcctaataaaagagaagctgcattttattggtttttatttttaattttctacacgtttgagctgagtcctgagacacttagcttccctctccctcattcccggacccttccaccccactgggcccaaccatgggctcaggaccctggaattccgttttctgatttgctttgggattttttttttttttaagatgttacatggtgtttcgaagccagcaagttaccatcctccggtgtctcttctctccacatctgtaacttctttttccaggttttattttcagttttaaattcctaataaattatttgaaaacgtt

SEQ ID NO: 12994 - DNA, 698 bp, Homo sapiens
  ENST00000546985
tggaccaggcgggggtggataaagtgctggcgcaatcgcggcacgagctcgactccaaaacaattgaccctaaggtggccttccctcggcgagcacagcccaagatggtgactcgaacgaagaagatctttgtgggggggctgtcggtgaacaccacggtggaggacgtgaagcaatattttgagcagtttgggaaggtggacgacgccatgctgatgtttgacaaaaccaccaaccggcaccgagggttcgggtttgtcacgtttgagagtgaggacatcgtggagaaagtgtgtgaaattcattttcatgaaatcaacaacaaaatggtggaatgtaagaaagctcagccaaaggaggtgatgtcgccaacgggctcagcccgggggaggtctcgagtcatgccctacggaatggacgccttcatgctgggcatcggcatgctgggttacccaggtttccaagccacaacctacgccagccggagttatacaggcctcgcccctggctacacctaccagttccccgccattcctctcactgcctacggaccaatggcggcggcagcggcggcagcggctgtggttcgagggacaggctctcacccctggacgatggctccccctccaggttcgactcccagccgcacagggggcttcctggggaccaccagccccggccccatggccgagctctac

SEQ ID NO: 12995 - DNA, 422 bp, Homo sapiens
  ENST00000546622
tcgccccaggaggggacaccggtggggctaacccggacccccagccatcttccttgccccctgccctggcctcaaccccaccgtcccactaggggcctctccagccaaggcccaggtggacgacgccatgctgatgtttgacaaaaccaccaaccggcaccgagggttcgggtttgtcacgtttgagagtgaggacatcgtggagaaagtgtgtgaaattcattttcatgaaatcaacaacaaaatggtggaatgtaagaaagctcagccaaaggaggtgatgtcgccaacgggctcagcccgggggaggtctcgagtcatgccctacggaatggacgccttcatgctgggcatcggcatgctgggttacccaggtttccaagccacaacctacgccagccggagttatacaggcctcgccc

SEQ ID NO: 12996 - DNA, 2269 bp, Homo sapiens
  ENST00000261507
agctctcgcaggccaataacgacaggacgggccgcctggcccacccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaat

SEQ ID NO: 12997 - DNA, 973 bp, Homo sapiens
  ENST00000507013
ccggctccacccccaagccaggcgaggcaggttccgaggttggaacacctggcgagtcctcggtgtcggtggccggcagtcatctcgcggccgttcaggtgagggggttggaggagtggctcatgagcgaggaagggggagcaggcgggctcccacccggtgctccgtgagatcgaggggagcgggttctgggtgcggatgcacgcgctgggcgggacgctggcagtggtacccgagacggggcggaaggagactggagtgaaggtgggcctaggctaagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgttt

SEQ ID NO: 12998 - DNA, 1789 bp, Homo sapiens
  ENST00000393766
aggcgaggcaggttccgaggttggaacacctggcgagtcctcggtgtcggtggccggcagtcatctcgcggccgttcaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtat

SEQ ID NO: 12999 - DNA, 1026 bp, Homo sapiens
  ENST00000504317
agtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccataggtgagtattaatttctgttcaggtataaagcataatgaaatatatttattttcatggccataagattatcatatttctaaggagactaataggagaagttaatcttcttaatgttatattaagaaaacataactgttggataaaagtttaaataatagatgtttttacattctagcctatgctgttataatttttatagtgataatgtgttattagggcaagtatatattcaggaccagcaatttccttatccttctgtaataaa

SEQ ID NO: 13000 - DNA, 482 bp, Homo sapiens
  ENST00000505270
gaaggtgggcctaggctaaggtacgtgctagaaaggatgaaaacggagtgaaattcttaagtgatggaactaggctagggcatgtttcttgccctttaaaatgtgttgtcttcgggagacaggacgtagaagatagttgcagcacagggtgataggctggcgaaagttatacaaaagcaggaaccactagaaggagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaag

SEQ ID NO: 13001 - DNA, 1536 bp, Homo sapiens
  ENST00000317173
ggaactcgccgggccacaccccctgtccagggaaggaacacgcccccggtgacagccggtacggccccgggtttgggcaacctcgattacgggcggcctccagccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcagtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataaggggctttctctcccttttcagccctctctgtgcagagaaaagatgtgagtccgcttgatgaattctaatgctttgcttagagctatgagaaatgtttgttttaataaaaacctacagtccaataatgccaa

SEQ ID NO: 13002 - DNA, 788 bp, Homo sapiens
  ENST00000441698
gccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttgaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaa

SEQ ID NO: 13003 - DNA, 674 bp, Homo sapiens
  ENST00000518255
cggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaagctggtgcttccctgttcttcctcagccatgctggggctcactgcagcctcctctgctcaactcgcctgggtgcagccatcttcaagaaaacattattaaagcaatattattagta

SEQ ID NO: 13004 - DNA, 814 bp, Homo sapiens
  ENST00000521209
tgaatgatagattattattttacattgtaggtacagccagtgtgatcagacaaagcaattcgagaactacaaaagaggaaaaaagatcagaagttcttaaatacataagggaatgcagcatttgataaagccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagatgttcagaacaattccatgtttattagtctattcaaaagcttttagaaatctgcacagccaagtggcactgaatccagaagcatgaaaggagctgcacaacttttcctcgtaagatttacacaagcagcacgggaaatctgaggcccagacatttccttatcaacagaatactccggtggattttcaagcaggctgttcagcagaggtttcgagcaggagcccaggtgtgggaagagcggagtgtgggagtcctcgtgtgaccctctgggggtggtgatggaactgactgtatggtctgcaaaacctaaaatatttactgtcaggtgcttatgtgtcctgtcctgagcccgtttcctctcttgtaaaatggggcaatgctgcttgatgaaaccagtcaagttgtggttggattcttatatgtaataaacctgcacattgtgcacatataccctaaaacttaaagtatgataaaaataaaaaaaattgttgcaaa

SEQ ID NO: 13005 - DNA, 871 bp, Homo sapiens
  ENST00000522907
agagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaaccaattagtgacaacactgaagaccagaaaggcaagctgaagacaccagacttcgcttgaagggcaaacaagaaatccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgcc

SEQ ID NO: 13006 - DNA, 1706 bp, Homo sapiens
  ENST00000528246
gagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaaccaattagtgacaacactgaagaccagaaaggcaagctgaagacaccagacttcgcttgaagggcaaacaagaaatccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcagtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataaggggctttctctcccttttcagccctctctgtgcagagaaaagatgtgagtccgcttgatgaattctaatgctttgcttagagctatgagaaatgtttgttttaataaaaacctacagtccaataa

SEQ ID NO: 13007 - DNA, 1092 bp, Homo sapiens
  ENST00000523637
aaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaacccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggtagggattgctgggctcctagcccctggcttaggccaccatgactagggccaggttctgattttagagggcagtctgctgcttttcaactggaattgtgttttatttgcacatctcttagaaatttctgtcagcctctaggagtggagccattgtgtctaatacgtgtgctaaatgaggttttaagagtaggcctgggccagggccagtggctcatgcctgtaatcccagtactttggggggccgaagcagaaggatacttgaggccaggagttcgagaccagcctgggcaacatgaagaaaccccatctctacaaaaaatacaaaaataagccaggcatggtggcctgcacctacagtcccagctacctggg

SEQ ID NO: 13008 - DNA, 1460 bp, Homo sapiens
  ENST00000382490
aaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaacccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcagtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataaggggctttctctcccttttcagccctctctgtgcagagaaaagatgtgagtccgcttgatgaattctaatgctttgcttagagctatgagaaatgtttgttttaataaaaacctacagtccaataatgcc

SEQ ID NO: 13009 - DNA, 559 bp, Homo sapiens
  ENST00000521686
aaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggtacccaagcatgttcactggaagaagagaacacagactgggctgcagacggagggaagatgagtatagggactctccttgtctgtccctgtacctgcccactgccacctgtctacgtcctgagatacccagcagaggacagggttccacttggaaaattcttttgaatctcacacaagacagtaataaacatagagggagaaataacaagacattttaccatgtcttgtgtcatgtaggaaactttacatttcagaaaatatgaagacaaaaagatgaaggaaagggctttaaggatacaaaggaccttattatggaaggaaagcagtgttgtcaagagagctaaaa

SEQ ID NO: 13010 - DNA, 596 bp, Homo sapiens
  ENST00000517594
aaaagaggcaggaaagacttaaggaggaggatggagtcttaaggagtgaaacttgaacttcacgctgggtttgctgaccttgaacatgctggattctgcttacagaatttgacagctgcttcatatctttggttttacttttcctctttgttattctcttggcaattagaagaaccgaagaggccagagtcctccgaagacgcctgcttggaagttgagatgctgttgctgaaactgctagaatgccaggcatgctatcacctgcagctttgagacgtcacgctgacagtatcacaggaaaacagccttttgtgggccgtcctctgtgtgttcacaccgtgtcgtttttaagctttaaaggaaactgacaaaagcttcttttctctctgtcttgagcttcactgcgtattcttaaccatgtggagctgggagctaacgcatcacagccaactgtatctggagtgcatttgctcatatagcccttattttattttttagtcttatttttagtttcctttgaatataataataaaaaaaaaaaacccaatcattgaattcttagcttcagccaatatagtgtgaggttagacatattg

SEQ ID NO: 13011 - DNA, 2241 bp, Homo sapiens
  ENST00000239243
cttcccctcggaggaaaggctcagctcccagcgcgcccctcccgtctccgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagacatatgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttgttctgtaggcggaggcaccaagccctgttttcttggtgtaatcttccagatgcccccttttcctttcacaaagattggctctgatggtttttatgtataaatatatatatataataaaatataatacatttttatacagcagacgtaaaaattcaaattattttaaaaggcaaaatttatatacatatgtgctttttttctatatctcaccttcccaaaagacactgtgtaagtccatttgttgtattttcttaaagagggagacaaattatttgcaaaatgtgctaaagtcaatgatttttacgggattattgacttctgcttatggaaaacaaagaaacagacacaatgcacacagaaaatattagatatggagagattattcaaagtgaaggggacacatcatatttctgcattttacttgcattaaaagaaacctctttatatactacagttgttcctatctctcccccgccccccaccgccccaccacacacatatttttaaagtttttccttttttaagaatatttttgtaagaccaatacctgggatgagaagaatcctgagactgcctggaggtgaggtagaaaattagaaatacttcctaattcttctcaaggctgttggtaactttatttcagataattggagagtaaaatgttaaaacctgttgagaggaattgatggtttctgagaaatactaggtacattcatcctcacagattgcaaaggtgatttgggtgggggtttagtaattttctgcttaaaaaatgagtatcttgtaaccattacctatatgctaaatattcttgaacaattagtagatccagaaagaaaaaaaaatatgctttctctgtgtgtgtacctgttgtatgtcctaaacttattagaaaattttatatacttttttacatgttggggggcagaaggtaaagccatgttttgacttggtgaaaatgggattgtcaaacagcccattaagttccctggtatttcaccttcctgtccatctgtcccctccctccggtatacctttatccctttgaaagggtgcttgtacaatttgatatattttattgaagagttatctcttattctgaattaaattaagcatttgttttattgcagtaaagtttgtccaaactca

SEQ ID NO: 13012 - DNA, 1188 bp, Homo sapiens
  ENST00000507785
gccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagtgagtgcgcgccggggcaggagtaggaggacatatgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttgttctgtaggcggaggcaccaagccctgttttcttggtgtaatcttccagatgcccccttttcctttcacaaagattggctctgatggtttttatgtataaatatatatatataataaaatataatacatttttata

SEQ ID NO: 13013 - DNA, 1542 bp, Homo sapiens
  ENST00000361624
atgttcgccgaccgttgactattctctacaaaccacaaagacattggaacactatacctattattcggcgcatgagctggagtcctaggcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctaga

SEQ ID NO: 13014 - DNA, 1378 bp, Homo sapiens
  ENST00000361381
atgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacgggcttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttcctctt

SEQ ID NO: 13015 - DNA, 581 bp, Homo sapiens
  ENST00000561491
gcgaacccgcgtgcaacctgtcccgactctagccgcctcttcagctcgccatggatcccaactgctcctgcgccgccggtgactcctgcacctgcgccggctcctgcaaatgcaaagagtgcaaatgcacctcctgcaagaaaagtaagtgggatcctctctttcctctaccccttccctgtcctccagcctgtcccctctccaccatcctcaggggaattaaagcagtctggggatgccccattgcgcggaaattgttgcctcctcagtgatccttatcagggagagcaggaatccttattcccggtgtcgctagtactcatctctgccgcctcctgtctgcccccaggctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgact

SEQ ID NO: 13016 - DNA, 416 bp, Homo sapiens
  ENST00000567300
ggctggggatgcccagtgtagactgtagcgctagagaagcaatttctgacccctctttctttctctggtcactcaatttcaggacaggagttgctccttcccaaagagttttggggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 13017 - DNA, 903 bp, Homo sapiens
  ENST00000562017
tccaagtcccagcgaacccgcgtgcaacctgtcccgactctagccgcctcttcagctcgccatggatcccaactgctcctgcgccgccggtaagaggctggggatgcccagtgtagactgtagcgctagagaagcaatttctgacccctctttctttctctggtcactcaatttcaggacaggagttgctccttcccaaagagttttggggtatctttctctccattctaggttattcggagccccctttttaccgttaaggagatctgagttaatggcttgctcaagttcccaggaatcggttgtggactgaggaactcggccccgggctcttagtacgccgtcccttgttcaggtatccagggacggttctcacctctgtcttttctccttgcaggtgactcctgcacctgcgccggctcctgcaaatgcaaagagtgcaaatgcacctcctgcaagaaaagtaagtgggatcctctctttcctctaccccttccctgtcctccagcctgtcccctctccaccatcctcaggggaattaaagcagtctggggatgccccattgcgcggaaattgttgcctcctcagtgatccttatcagggagagcaggaatccttattcccggtgtcgctagtactcatctctgccgcctcctgtctgcccccaggctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 13018 - DNA, 786 bp, Homo sapiens
  ENST00000245185
aagcagcattcccaagtcccgctttcacccgcgcgctaacggctcaggttcgagtacaggacaggagggaggggagctgtgcacacggcggaggcgcacggcgtgggcacccagcacccggtacactgtgtcctcccgctgcacccagccccttccgcgccgaggcgtccccgaggcgcaagtgggccgccttcagggaactgaccgcccgcggcccgtgtgcagagccgggtgcgcccggcccagtgcgcgcggccgggtgtttcgcctggagccgcaagtgactcagcgcggggcgtgtgcaggcagcgcccggccggggcggggcttttgcactcgtcccggctctttctagctataaacactgcttgccgcgctgcactccaccacgcctcctccaagtcccagcgaacccgcgtgcaacctgtcccgactctagccgcctcttcagctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 13019 - DNA, 688 bp, Homo sapiens
  ENST00000563985
accacgcctcctccaagtcccagcgaacccgcgtgcaacctgtcccgactctagccgcctcttcagctcgccatggatcccaactgctcctgcgccgccggtaagaggctggggatgcccagtgtagactgtagcgctagagaagcaatttctgacccctctttctttctctggtcactcaatttcaggacaggagttgctccttcccaaagagttttggggtatctttctctccattctaggttattcggagccccctttttaccgttaaggagatctgagttaatggcttgctcaagttcccaggaatcggttgtggactgaggaactcggccccgggctcttagtacgccgtcccttgttcaggtatccagggacggttctcacctctgtcttttctccttgcaggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgat

SEQ ID NO: 13020 - DNA, 514 bp, Homo sapiens
  ENST00000561640
ttcagcaacccgtctgaacagatctggcgtcctggagaattctagaatgaaggggaagagaggcagggaagagctgggaaatacgcaaagcgcctttttctccactttcggagatgccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatccc

SEQ ID NO: 13021 - DNA, 421 bp, Homo sapiens
  ENST00000565838
ttcagcaacccgtctgaacagatctggcgtcctggagaattctagaatgaaggggaagagaggcagggaagagctgggaaatacgcaaagcgcctttttctccactttcggagatggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatg

SEQ ID NO: 13022 - DNA, 569 bp, Homo sapiens
  ENST00000200691
acacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcatga

SEQ ID NO: 13023 - DNA, 1550 bp, Homo sapiens
  ENST00000566451
cgtccagttgcttggagaagcccgttcaccgcctccagctgctgctctcctcgacatggaccctgagacctgcccctgcccttctggtgagcccccgcccccgctcgcatcctgcgcactgcgcgcccttgtacctgcaaagaaacccacgccctgcgccttcgctcaaggacacttgggggaagggcccctgattccctattcttcacctcgtgaagggcgggcatgcctgtgtcgcggagaacagggagacttggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccctctgccgccgccccctctgctctgcggagtcggtgtctcaccacgcaggatgtggagagacagccaggccccgatcccgtggtttctgactcttgctggaatagaaccacccgggcagacattaaaatacagatgcccctgccccacacccaggaattgatggcctaggcgtgggacgagaggtttttgtaaatccccagaagactccaatggcagctgggattgaggactgccacactggtccaacctttcccgacccatccctcaaaaactccccaaaacctggggaagccattagtgaggctgcggctcagctctggagttccggtcccttggcctctctccggccttacggatcctctcagtttgatctcaaaatctccccagctcacggcagtgtaatatgcatagggagtaagaggtgggaggaaggctcccttcttccctaggtatgaaaccaggcacaggtccccaccgcctccccacggctttcctgggccccttacatctgcaccatatctgcccctcccaagtttatcctttgaggcccctttcaaggtcgtttaccctgtgatgctttctccttaaggcctagtacccacctaagctgggcttaagcccaccagcccccaggacttcctggcatccacccaaggggctctggtcatttcctgggtacctcactcctgtggaggtgcaggatgccactgccgcgacatagatgctgagtcaaagcaggtgtgagactaagaagggggctgcgactagccctggctgaatgaaccaggatgactccccacccagcacccttccctcccctttgatggggacgaattgggggagtgtgcatcagagagtggtcatcttccattttatctgcaggctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagca

SEQ ID NO: 13024 - DNA, 579 bp, Homo sapiens
  ENST00000570176
cagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagtgagtgcggggacccttcccctctgccgccgccccctctgctctgcggagtcggtgtctcaccacgcaggatgtggagagacagccaggccccgatcccgtggtttctgactcttgctggaatagaaccacccgggcagacattaaaatacagatgcccctgccccacacccaggaattgatggcctaggcgtgggacgagaggtttttgtaaatccccagaagactccaatggcagctgggattgaggactgccacactggtccaacctttcccgacccatccctcaaaaactccccaaaacctggggaagccattagtgaggctgcggctcagctctggagttccggtcccttggcctctctccggccttacggatcctctcagtttgatctcaaaatctccccagctcacggcagtgtaatatgcat

SEQ ID NO: 13025 - DNA, 448 bp, Homo sapiens
  ENST00000566576
gcttggagaagcccgttcaccgcctccagctgctgctctcctcgacatggaccctgagacctgcccctgcccttctggcgtggggacccgagttcgtccacattaacccttcctgtggcgtcgccctctctaggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcatga

SEQ ID NO: 13026 - DNA, 2006 bp, Homo sapiens
  ENST00000373616
cccgccgcaccacgctcccgagctcccccgcggcctggagtggtgcgccccggccccgccccctgacgccggtgagggggcgtggccccgtcacgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 13027 - DNA, 2057 bp, Homo sapiens
  ENST00000373627
cccgccgcaccacgctcccgagctcccccgcggcctggagtggtgcgccccggccccgccccctgacgccggtgagggggcgtggccccgtcacgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 13028 - DNA, 629 bp, Homo sapiens
  ENST00000471737
atccctcttaccgggtctccttctcgggactcccttcagtccacttaccccgtttctgccccccaggccttctctgggcagtgactgtgagggctgacaggaaaggcatgtgcagcgtgcttgtgaggagctcagcacagagggtggggtgagggcatgtgttgctgaagtctgcatcctgaggtgcctgtggcaaaccactcttcccttctgtctcctcagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatg

SEQ ID NO: 13029 - DNA, 602 bp, Homo sapiens
  ENST00000418541
atgcagtgtgtgtcccgcatgttggcccaccccctgcatgtcatctcaatgcgctgcatggtccagtttgtgggacgggaggccaagtacagctgtcctgcggggccaccatcccaggaagctcagctgccatggtgcctcattttggggtcattaatgggaaattggcccattcccctagactgattatgagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgcc

SEQ ID NO: 13030 - DNA, 1572 bp, Homo sapiens
  ENST00000460219
gcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcaggtgagcaagcactggacggcggaggcctttcctgttctttgctacatccttcagctgaaatggttttgtggatgcttcattgcatgcaaagataagtggtttcatggaattcaatattgtgaggagatacttggtatctataaggcatttaagttttcatcttacataatttcagaaaggatttgaggtggctaagtgtgggtttattttaagattatacatcagacaagaccttttcttctttgagtcttaaagactcttaggataaggataagagaactctggcccaggtggcaggtggtaaagcccaagaactgcttctccttcaagtaacatgggctgaaaattcgaggtctgtaaccagttgagctgagttcctgggttgttagggcggctggcattggaaaccgactcctccctcctgcaggacattcctgggcccaggagagcctgtgggtggggctgggccacgtggggaactggcagcagtaccaaccttgggttctcgtgttctgtaccgaagctacctctccgtagctggagctcttgggcccagcagtcaggggtccaggc

SEQ ID NO: 13031 - DNA, 373 bp, Homo sapiens
  ENST00000492754
aaacgaccagaatccaggttcccagttcagccaggccctggccatccggagctataccaagttcgtgatgggggtaagttgtgccagctgtccttccttcccactgccttgcggacccaagcggggcctaggaggccaaccctggtaatggctggaggcaggtcttggtacagggtgttggcgtggtgtgtccctgctccctgggccggggtgggtcactggcactcaggcctctctgggtttcagattgcagtgagcatgctgacctaccccttcctgctagttggcgacctcatggctgtgaacaactgcgggctgcaagctgggctccccccttactccccagtgttcaaatcctggattcactgctgga

SEQ ID NO: 13032 - DNA, 581 bp, Homo sapiens
  ENST00000539759
ccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatgtg

SEQ ID NO: 13033 - DNA, 2587 bp, Homo sapiens
  ENST00000302503
ggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccatacagttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatgt

SEQ ID NO: 13034 - DNA, 811 bp, Homo sapiens
  ENST00000534074
cttctgcaaagcacctcgcaaatcttttgcctccctgcttacagttatgaatagtaaggtgagccactgagggtatagccgacctgcattttaaacataggaacaaaagtcactggagatcagcttcaagtacagctgtgttaacgagaatgaactaggtatgcgggctggattctggtgtttgattccttttttacttccctagaatgttttgtgacctctaattatttgacaaacatttgtactgaagagcctgtcatgttactgatcacattttttggttcttatttttattgtttcttcatgtaggggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtt

SEQ ID NO: 13035 - DNA, 599 bp, Homo sapiens
  ENST00000525649
agtatcgatgggaggcgcgggttgttcacaggcttaactccaagactgtgttcgggagtccttggaactgtggtccatggtaaagttttacagcattaccaggagagtgacaagggtgagtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgtta

SEQ ID NO: 13036 - DNA, 930 bp, Homo sapiens
  ENST00000530428
ggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgct

SEQ ID NO: 13037 - DNA, 535 bp, Homo sapiens
  ENST00000533571
gctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatg

SEQ ID NO: 13038 - DNA, 1370 bp, Homo sapiens
  ENST00000266263
gaataaagagatgctggataagcccgaggtcacaagctttgcagtgtagcatcccccaacttgatcccctgtctctttggctccaaaacctacactcagtcctgggagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggt

SEQ ID NO: 13039 - DNA, 648 bp, Homo sapiens
  ENST00000614920
gcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgagtgttagcctattttccaacccccaaccctagctctcttcttgtgtggttcagtccacagccttgcatgtgataaagtccctgtgggacactccagtccctacaaccttgcctagtgcagtccatagacagtcctgtttgtaggacagtgtacccctgcccccacactcccactccccgaactggatgtggcagactgtaccccactcctgggtgcggacaagtccactggccacttgcccctcccggtctagcctcgtgccccttgtcgcaggattttctgcctctgccccagctggattaagtgtctctgcgcccaccaggtgcccagccctgaagcaggcc

SEQ ID NO: 13040 - DNA, 891 bp, Homo sapiens
  ENST00000355143
cgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggt

SEQ ID NO: 13041 - DNA, 759 bp, Homo sapiens
  ENST00000412752
actttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggattttctgcctctgccccagctggattaagtgtctctgcgcccaccaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcac

SEQ ID NO: 13042 - DNA, 912 bp, Homo sapiens
  ENST00000407550
ggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagc

SEQ ID NO: 13043 - DNA, 482 bp, Homo sapiens
  ENST00000629597
actcagtcctgggagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggattttctgcctctgccccagctggattaa

SEQ ID NO: 13044 - DNA, 3604 bp, Homo sapiens
  ENST00000367321
tgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 13045 - DNA, 1049 bp, Homo sapiens
  ENST00000367307
tccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaatggtgctgcatttttcctttt

SEQ ID NO: 13046 - DNA, 996 bp, Homo sapiens
  ENST00000367308
gtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaa

SEQ ID NO: 13047 - DNA, 1134 bp, Homo sapiens
  ENST00000441122
gggagaggcgggctcgggcccagcgccgcccgcgcgaagctccctggtgttgtgcgcccttccccgcgcgcggcccctcctgctgggctggggtctgtggctgacgtccgcttttcccggaacggcaaagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcc

SEQ ID NO: 13048 - DNA, 524 bp, Homo sapiens
  ENST00000423867
gtgcgcccttccccgcgcgcggcccctcctgctgggctggggtctgtggctgacgtccgcttttcccggaacggcaaagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttg

SEQ ID NO: 13049 - DNA, 373 bp, Homo sapiens
  ENST00000421497
ggtcctaggctcacctaagccagaagagattccccttacttggatacaaccaggaactactgttctcaactgctcccatgacttcctgtcagaaagtttgattatcattagaagaatggccatcttttaaagtgattcattgacttgtccctggagaaatcatgagttagatgagagtgtttagtgggaagtgaaaagacccgtccacggtttcggatgagatcctcgttggactgtgatcccaggatattacccaggcccagatcgtagacaacctcccaatggagtcctgcccctacacgggcagggggtgaaataatgattccctttcttaattttctttagccatgaaatttattaaaaatgtatgtct

SEQ ID NO: 13050 - DNA, 421 bp, Homo sapiens
  ENST00000478643
ggacacctgtgttcgtgcatgcgggcccttttgctaacattgctcacggcaactcttcagtgttggctgataaaattgccctgaaactggttggtgaagaaggatttgtaggcttgttctaggcatgaagtgcagtgatgatggagaaggcatggactgtggcacaaatagaagagtcaggggttggcagctcctattcccactgtacgatgccaaggatctttacctataggataagccttcagaaacataatttggtctttcaagtgctgaatacctcttgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagt

SEQ ID NO: 13051 - DNA, 606 bp, Homo sapiens
  ENST00000420192
aacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcagccattctcttgatcccagtgggggctggatgaaggaagagcaaaacaaaccacgaagacagcctggagccgcagccagctctgctgacttctgaacttcacgctctcactgcccagatggccaggggtgtttcctcctctgctggtcttttttaaggcaggatgtttgttgttattgttgttgtttttctggttggttcttaagaaattattttctacatcttgaaaatgccagctggaacctacaccagttgttggtggggtgtgagaactatcctttacatggacttggagcatttgcaactagagcctccacattgaaataaac

SEQ ID NO: 13052 - DNA, 503 bp, Homo sapiens
  ENST00000453602
gtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactattaactg

SEQ ID NO: 13053 - DNA, 427 bp, Homo sapiens
  ENST00000450635
aatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgggaggcagagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactat

SEQ ID NO: 13054 - DNA, 3159 bp, Homo sapiens
  ENST00000618312
acgtgcgcagccggccgccggctctgatgcaatcgcgccgggcgcgacccagacgagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaacc

SEQ ID NO: 13055 - DNA, 3475 bp, Homo sapiens
  ENST00000611279
cccctaggggcccctgggacgaggaggaagcgccaggtccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaacc

SEQ ID NO: 13056 - DNA, 1798 bp, Homo sapiens
  ENST00000429519
ctcgttcaccagagcacctactatgttccaggtggtatcataagaacttgggagacatcactaaacaaaatagaaaaatccctgcccttatggagctgacattctagtgggggcttggtttttttccttgggtactgggtttgtttttccatgatgagcatatcctatgatgcactatagcactcaagcaagatgcctgaagcaaaggaggccaaagtaatgattcatggattcagcacactttcctttgttgaaaagcactgcttgttccccctcaaagctatgtgagaggctgtgtaggagagagtggagagcaggtagcctaccggacctacagttcaccatttcagccctgtaattgaccagctgtgggacctcagtgtgaagcttattcatgaagagacctctgcctgaacatacagcaaatttaagaaggttgtgcagatagtctgaaggaggaccagcagagagaagagattccatcttccagagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcagagagatttcaccattttgcccaggacctctccaactcctgaactcaagcgatccacctgcctcagcttcccaaagtgctgagattacaggcatgagccaccacacccggcactatataagtattttagaccttagaaaaacctatctagttttaaatttgtcttattaattttcttgacattgctaaaaaaagaagcatgtatatccattcatgcaatattcctcagcagtgaaaaggaatgaactattgatacagcaacctgaatgaatttccagcaaattatgaagtaaaaaaggcaatctcacatgttctttgttcaatcatagaatatatgattccatttatatagcattcttgaaagtgacaaaattagcggtttccgggagtcaaggacaggttgatgtgggagggaactgggtgtggctgtaataaggcaacatgagggacccttttgatgatggaaatgttctatatcttaactgtatcaatgtcaatatcctgggtataatattgtcctgtagtttggcaagatattatcattgtatagtatcttgtattatttcttacaatggatgtgaatctataattatcaaaaaatgacaatttaattaaagcatatagtaaataagtaaaaaaataaaaa

SEQ ID NO: 13057 - DNA, 689 bp, Homo sapiens
  ENST00000490698
acaacaagtccccagggacagctaagcactccagtgtctagggactgtgggaaactggaaagaaacaatccagtgtaaatatgacttctaagctggctgttgctctactgctttcttggcagttgcatgctttctgtagcactgtgtgaagtgtgaagcttattcatgaagagacctctgcctgaacatacagcaaatttaagaaggttgtgcagatagtctgaaggaggaccagcagagagaagagattccatcttccagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctca

SEQ ID NO: 13058 - DNA, 954 bp, Homo sapiens
  ENST00000475291
aatccagtgtaaatatgacttctaagctggctgttgctctactgctttcttggcagttgcatgctttctgtagcactgtgtgaagtgtgaagcttattcatgaagagacctctgcctgaacatacagcaaatttaagaaggttgtgcagatagtctgaaggaggctggtgcagcatggaaacacggatttgagctcattactccaattttcacgctgagtttggaagggtcctagagggaccagcagagagaagagattccatcttccagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctcaatgagttttcctttaaaatttgcagtgaatttgttttcctgtttatgcatgagaatttaggtcttattaattgggggaaattaatgttaaagtaataaataagcccttgttgcagcttattgtttcttgaaatgaattaactatccaggcaaaaggttaaaaatgaaaaaaaaagtctttgtaactaaatttttcccattttgttgtggtatttgaggagtttacaaatcaaaatgtcctgggttaaaaggcatca

SEQ ID NO: 13059 - DNA, 786 bp, Homo sapiens
  ENST00000429335
agtgtaaatatgacttctaagctggctgttgctctactgctttcttggcagttgcatgctttctgtagcactgtgtgaagtgtgaagcttattcatgaagagacctctgcctgaacatacagcaaatttaagaaggttgtgcagatagtctgaaggaggctggtgcagcatggaaacacggatttgagctcattactccaattttcacgctgagtttggaagggtcctagaggacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaagctgtgcaactttgttcaggatttgaaatgctcgggatataagagtacacaggcttgctctttgtccagtagctgaccctaaagctaaggagaaataaaaatgaccgaatgcagatgctttcctactcctgtcctgaccgtgcagagattcttatcaataagtggtcactttgtcgagttgtctagtttgaagcctttgaggattagcaccttccagtttattcaagggaattggacaaagaa

SEQ ID NO: 13060 - DNA, 2007 bp, Homo sapiens
  ENST00000423607
gccccagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgaggaccagcagagagaagagattccatcttccagagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaagctgtgcaactttgttcaggatttgaaatgctcgggatataagagtacacaggcttgctctttgtccagtagctgaccctaaagctaaggagaaataaaaatgaccgaatgcagatgctttcctactcctgtcctgaccgtgcagagattcttatcaataagtggtcactttgtcgagttgtctagtttgaagcctttgaggattagcaccttccagtttattcaagggaattggacaaagaaatgagaatgaactataggattaaaggataaaactaaagaagattgagcccatgtgactactggacaatagattgtaaaaggaagagacatttttggaaccacttccagactgagatggttaaaagctgttgtgccctcctccttcacttctgtttctgttgcattgttcttggaaactaggtattacagatggttgtaaattacaaaaagtagggcagtagaattcttattggacttgacatgaataagaaataaatacccttttataaatgactgggatttcagatttttttaaacctataaactcacagatcaaagaagctcaccaaactctcaagctcatgaaacatgaagaaaactatgccaaagaacaccataatcaaattattcaaaaccactgatagaaaaaaatcttaaaagcaataagggggttgggggagggcattacatacaaaggaacaaagaggacagtgacagaatatttattgatagaaacaatgcaagcaagaagacaatagaacaatatctttaagtattaagaggaaaaaaaacacctgtaaacccaaatttctatacctagtgaaaataccttcaaaaacaaaggcaaaaagtcttttatgagacatgtgaggaagagagctcaaaactaaaaacaattatttactagcagacctatgatctaagaaatactaaaaggcccgggtgtggtggctcatgcctgtaatccctgcccttgtgggtggatcacttgaggtcaggagttcaagaccagcctggccaacatcgggaaaccccatctctactgaaaatacaaaaatcagctgggcattgtggtgcacacctgtaatcacagctactcaggaggttgagacaggaggattgcttggacctgggaagtggaggttggagtgagccaagatcatgccactggactccagcctgggcaacagagcaagactccatctcaacaaccacaacaaaaaagagatattaaaggaagtccttcacctagatggaaatgatactagatggaaatatggatctgtccaaggaattaagagctctggaagtggtaactacctgaataaatatatattattcatgtatatatatgttataatatattgttcttattcttattattcagattattttagaagataattaatgtttaaccaaagccaaaaacaatgtagtttgtggtttgtaacatacaattaaaatgtatggcaacaatagcacaaaa

SEQ ID NO: 13061 - DNA, 2363 bp, Homo sapiens
  ENST00000461101
ggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgaggaccagcagagagaagagattccatcttccagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctcaatgagttttcctttaaaatttgcagtgaatttgttttcctgtttatgcatgagaatttaggtcttattaattgggggaaattaatgttaaagtaataaataagcccttgttgcagcttattgtttcttgaaatgaattaactatccaggcaaaaggttaaaaatgaaaaaaaaagtctttgtaactaaatttttcccattttgttgtggtatttgaggagtttacaaatcaaaatgtcctgggttaaaaggcatcacatgagtttgtgcccattgcttttcagtgtgaggagtctgatagcagcccatcccatttgggtgggaaggttatagaccttgcacattaatgccatgctcaaagcagatttgcaggtatcctgcaacacagggactttcacaaaacccgctttggcttattctacctgaactacttattttaattaactaaatggatatcccaagcattccatgtttatcctgttgctcagtgaatcctcaaatcgttaatttggtagattctcttttttgtcttcatactattatttcttttagcttttaaaaaaattgtgtactgcctacaggtctttatggaagtttcacctttctttgtgtcgcactggcatcggctgtataatttttgcagctagaccacattttaaaaaaatctacatttttggaactagtaaaagatacttatttgtgttatttaagtattcacgtcttttaccgtgggtagttaagtttaataatttaaaaagacacattttatcagtaacaatgttcattttatttttcagactcttccctctactacttactctgtatttctgtctcttctaatgactaggaaaggcagtttctcaaaatcatcttctatttagttggcaaatgtgataatgtgggtagtgttcctaccttcctgctgtatgtgttctactgaaatgagatataatagccatctggctacaattttgatttctaagaagttcttatgtcattttaaattcaaaaactaagtgtttcaacatttggtctctcatatcttaagttttattttctttgttccagctgttcagagatagtgtgttctaatatctccacaatcaagatttttgactaaaatggatcagtacatgaaaaagagggactagtattaattttagatcttgttagttaatcatggtcttactaataatttggcaagttctttaatgagccaaatctttgtatttcaaatgccttgaagttgttattctttcctattagtaccctgatgggaggatgaaaacagcagaaaggagcagcaccagatgatcttttcatgggcacgtactctttcaaggaatcccatggagctcagtgaaattacactttggcttagagataattaagttgtggaaggaggtttaagagaggagcttaggtgaaatttgagctgtaaatgagtatgctaaattaaagaaatgattagtaataaatgagatttgctattaagaaattcactttggatctgagacaacattttacatacaatgtagaaaactttatggtcagaacagaacacagtctgaacctaaattaacagtagtgttaaagaattcagggcgggatattatccaagaaggcctagccagctgctccacttaatgttacatcacaagtggtttctgtgttgctattgtttttattagcatttcaatgactgtgtcatattacattaaatcaattggctctaactta

SEQ ID NO: 13062 - DNA, 954 bp, Homo sapiens
  ENST00000359107
ggtccgcggcttctcgctgctccgcggccgccttggccgagcgccggcgttgggcagaagcacagcaccctccgtaagggcaccgggagagcccgggagtgcgttccggggctttcggagcagcggtgtgaggaccagcagagagaagagattccatcttccagagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaag

SEQ ID NO: 13063 - DNA, 2300 bp, Homo sapiens
  ENST00000325278
gcggccgccttggccgagcgccggcgttgggcagaagcacagcaccctccgtaagggcaccgggagagcccgggagtgcgttccggggctttcggagcagcggtgtgagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaacatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttgaagaaaa

SEQ ID NO: 13064 - DNA, 468 bp, Homo sapiens
  ENST00000484725
ggccgccttggccgagcgccggcgttgggcagaagcacagcaccctccgtaagggcaccgggagagcccgggagtgcgttccggggctttcggagcagcggtgtgaggaccagcagagagaagagattccatcttccagagtaccctgatgggaggatgaaaacagcagaaaggagcagcaccagatgatcttttcatgggcacgtactctttcaaggaatcccatggagctcagtgaaattacactttggcttagagataattaagttgtggaaggaggtttaagagaggagcttaggtgaaatttgagctgtaaatgagtatgctaaattaaagaaatgattagtaataaatgagatttgctattaagaaattcactttggatctgagacaacattttacatacaatgtagaaaactttatggtcagaacagaacacagtctgaacctaaattaacagtagtgtta

SEQ ID NO: 13065 - DNA, 3181 bp, Homo sapiens
  ENST00000492183
ttataaatgcctgtatcagattggggacttaaagatttgcttctcctctggtgaaccacaggtacaatctctggtaagttatcttatccttagatgagcttcttggggtttgtttcctgtgtgtttgttcaggggtcattcagagatacagaatttgtatacaatgtatgggactcctttctgtggctttctcctttcctggatatatcgcttcaattttcaactacggtgttagccccaaacttcatcttttgatctcttaagcaagtaggactgaatatttctatccaaattctagctgtcctgtggctagaaaagcttttaaagtggagaactctttcagtgatttttttttctttaagctatctactttcctctacatctgtttgtttttagtgactttccatttttttcagatagttgtttttgtattttttcaaatgattttactgaagtttgcagttgttttctgtaagaagtttagtccaatataagctacttcacaatcactagaaactgaacctacatttttaaatagtgtggtcagaattgtcctcactgatgttaatcaagtttagcctaaagctgcctccttacatatttaagattagcctaaaggtttttctgtatattgtgaactataacaagtagaggtgtaaaccaatcgtggcccacacctgtgccaatcactgagttttggccaatcaagtgtagccagctgctcgaaccatgttcaaataaggcaaacactgagctgtaaccaatccagttgtttctgtacctcacttctgatttctgtgtgttgtgtccctttttttgtctacaaatcttcttctaccacgtggctgttctggagtctctctgaatctgctgtgattctggggggctgcccaattcgttaattgttcattgctcaattaaacatctttaaatttaatttggctgaagtttttcttttaacagtgagaatgtggtatttaagaaaacatttgaaagaaggtagggatttagcctaggtgacagttcttttttaggaaagccttccaggcagatagaaagctatagctaaggtggcaaaatgcctcatgttttcaaggaacatcaaggggaccagcttgatgctcacagattgagagaagacgagagtaaccagtgatgggattagacacatagctatggttttggtgcagtaaaaatcatgtagagccttgtttgcaatttttaaggtaataacattgcagggttttgagaaaagcaatgtgatcaaatatgtacttcaaaggtataactctattgctgttttgtgaataaattgtatggttgcacatatagaagaaggaaactaattaggaggctgtttcaagaattgacaggaagaataatgttcactcaaagtagagtagtatcatgaacatggtgagactgataaagtgctagatatattattatgaagaaagtcaacagattttccaatggtttggatgttaggtgtgagagaaagagggatatttaagatgactccaggttttcttggcaagtagcacagaaggatgggtttcccattatgaaccctgaaaatctgagacaaatgtcagtttattttgccaaggttgaagacatgcacccattagacagcctcagagtcctgaaaacatgtgcccaaggtagttgggccacagcttggttttatacattttagggagtcgtgagacatcaatcaacatatgtaagaagtacactggttccatccagaaaggcggggacaacttgaagcaggggaggagtcttccaggtcacagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagc

SEQ ID NO: 13066 - DNA, 593 bp, Homo sapiens
  ENST00000461856
gaggaggtcctgtgcagccttctgactcctttattactttcacagagtcagattgctttcttctaaaatagcccctctatgtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttga

SEQ ID NO: 13067 - DNA, 1268 bp, Homo sapiens
  ENST00000465255
gacagaagtgacattatgctggtttcccagtccaagcattaagaggctggtaactaatacttcttgtctcctggaacactcactcttggaagccagctgccaagctgtgagaaaccaagccccatgaagagttcatgcatatgtgttccagttgacagccttagctatgctcccagccaatcacaagcatccactgcaaccatgtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaa

SEQ ID NO: 13068 - DNA, 478 bp, Homo sapiens
  ENST00000490128
gtattccaaagttgattacgtctgatatggttaaagaaggtgctgctgtaattgatgtgggtatcaactatgtccacgatccagtgacaggaaagacaaaattagttggagatgtggacttcgaaggaaaagtgaaagagagagcccagaacaataaaatccatctttaataaaattgaactagaaggtgcatgcatcacatctgctagctttctactgacctgaatatagtcatgtgtggagtacaagggatgtggaatccatagtctctgaatgggaggctacactttggatgccacgataatgaacatctcaatatatttagaaaacttgtggaaacctcaagattcagcaaccagatgaatgtaagaagaaatatagtaaattccctccggagcacttgattcctggttgccttccaagttcaatggcaagctactaacttgttaaggagccctctgctccctggttcaccatg

SEQ ID NO: 13069 - DNA, 2354 bp, Homo sapiens
  ENST00000395759
cagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaacatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttg

SEQ ID NO: 13070 - DNA, 1407 bp, Homo sapiens
  ENST00000433372
agtgtgaagcttattcatgaagagacctctgcctgaacatacagcaaatttaagaaggttgtgcagatagtctgaaggaggaccagcagagagaagagattccatcttccagagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcagagagatttcaccattttgcccaggacctctccaactcctgaactcaagcgatccacctgcctcagcttcccaaagtgctgagattacaggcatgagccaccacacccggcactatataagtattttagaccttagaaaaacctatctagttttaaatttgtcttattaattttcttgacattgctaaaaaaagaagcatgtatatccattcatgcaatattcctcagcagtgaaaaggaatgaactattgatacagcaacctgaatgaatttccagcaaattatgaagtaaaaaaggcaatctcacatgttctttgttcaatcatagaatatatgattccatttatatagcattcttgaaagtgacaaaattagcggtttccgggagtcaaggacaggttgatgtgggagggaactgggtgtggctgtaataaggcaacatgagggacccttttgatgatggaaatgttctatatcttaactgtatcaatgtcaatatcctgggtataatattgtcctgtagtttggcaagatattatcattgtatagtatcttgtattatttcttacaatggatgtgaatctataattatcaaaaaatgacaatttaattaaagcatatagtaaataagt

SEQ ID NO: 13071 - DNA, 3013 bp, Homo sapiens
  ENST00000360900
aagcgtcgcacagcgactgcatcaccatggagccgagggcagtaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttatttttttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgca

SEQ ID NO: 13072 - DNA, 3623 bp, Homo sapiens
  ENST00000625049
tattgatgcttaacttggggcctgtgtacttcttgtagtttggaggcccatgaatagtctttatcgaccctgggaaattgtacagaaaattgtgggtgagtcattcttgggagggaaccccagctcctcacaaaggctcctctctcaccctgccaaggataaggaccattgctctaaattacatattattctgaatgtaatgagagcattgatactagttgaactatttcatcttgtagaacaatttacagttgtctagctcatgtgctgccctgtactgcgacatattcacttctgttggaggcctgcaggtgaccatggcttgcctcttgatgaccatgctcatgtgaaagcttggtgcccaaaagaaaaataaaaagcatctctaaagaatgagaattgtcaaaaaggactacacagtgtctgtctgtttcttttttgcacagggcacggtggtccaggcgtcacctgacttgtcctgacccataggcagcccccagtgcaaactgccccacaggacagagccatcaggccttcaccatttaggctgcatcaagccagttccagtctgttccaaggggcccgctgccgtagctaattgattagaaaaatccagataaagccaaagatgtcctttgtctgcaagtcgcatacaattgagacttaagtttcgcatagcgttactgatttcatagtttgatgacccatcgctaggaagtgttttcaaagctgtgtttcagacttgccttgcttctgcatttttggctgtgcattgaagggggtgacccctgagagacgttccttcaggggagaggagacccctgtggtcttattaaagtcctcatcccacccaaaggtacaggtagggggcagatgcggaggcagctccccattattctgggggggtcattaggggagctgccttttgtgaccctataatcccaatagtagcaatcttaggtgcctcttctgggtaggaggcctgagcagagagccccagctttactttcctgcttctgggcctggaggaaaatggaggcccaaccctgcagcctccacagctcgtggcaaacgctccagagcccccgtgagtgctgacttcccttaagccaggggcgaggggcagagctacagactggtgacatcgtctgtgtgagatagtgggtgggacagtgggagtcccatgtccctggggctcagaccacttggcatccagtccacgtgtgcagcacagccagtagtcagaggtgtggatgcgtgtgtggcaggtgcccctgcgattctgtccctgaaagagctgcaactgctttgcttttcagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttatttttttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctg

SEQ ID NO: 13073 - DNA, 2451 bp, Homo sapiens
  ENST00000546093
actacgcgccagaacctgcgccgggaagcgtcgcacagcgactgcatcaccatggagccgagggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaaggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgcc

SEQ ID NO: 13074 - DNA, 1207 bp, Homo sapiens
  ENST00000634347
gcacagcgactgcatcaccatggagccgagggcaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccat

SEQ ID NO: 13075 - DNA, 1207 bp, Homo sapiens
  ENST00000543303
gcacagcgactgcatcaccatggagccgagggcaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccat

SEQ ID NO: 13076 - DNA, 1210 bp, Homo sapiens
  ENST00000381214
gcacagcgactgcatcaccatggagccgagggcagtaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccat

SEQ ID NO: 13077 - DNA, 1270 bp, Homo sapiens
  ENST00000566050
gcacagcgactgcatcaccatggagccgagggcagtaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcaggtaattccacttccctgagccgagccgagacctggccgccaagggggacaccttttccagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccat

SEQ ID NO: 13078 - DNA, 556 bp, Homo sapiens
  ENST00000567539
actacgcgccagaacctgcgccgggaagcgtcgcacagcgactgcatcaccatggagccgagggcaggtgtctccaaacaggacatacgtgaacaaatttggggctacatggaatcacaaaatttagctgactttccccgacctgttcatcacaggatacccaactttaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttgg

SEQ ID NO: 13079 - DNA, 691 bp, Homo sapiens
  ENST00000562096
ttttcattctttttaagtatgagtcttgctaacataaagctgacatgagtgtgatctgtttccctttgtgacatgcttgaacggtccagtgttcacgtcattgtagtttcaccacctgacattggccgtgttgttattcctgttgaatgcccaaaagtccatcgtcagtgtgggctgcttgtgggcatttggtgggcatttctgtgaaaatttctatagattagctcgggatattgggttcaagtttcttcttccactggacctgatggaaaatccacttctcagcgatgccccggaccgcacagcgatactgattctcggttgtctcttaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgc

SEQ ID NO: 13080 - DNA, 1142 bp, Homo sapiens
  ENST00000562940
ggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagattaggtaatggcacaggttgcaaattagtctgcagtaggagtttgaccctgcaaatcagcctgtaggttatgatgctgtctctgctggcaaacagccagaattactgagaagacatttgtgcttcgtgtggacaaaactactggtcaaataagcatacgtgtccacgtctcccattctttaatcccaaatcattcaccgtttgaatccctcctttgggcatggaaaattaacaacatcacctctaaggatgaacacagaatacctgctgcttttgccacagcccagccgggactttccctgcaggtgtcctgggcaggcactgctggggactcccaggtgtgcactcctcggttggccgctgatgaacgcagagggaacagcctttgtaacccagagtgtatgggcggccctctaagcgcaccaggagcactgggaaagaaggtggtcactgctcttccaggaaatgaaaatatccct

SEQ ID NO: 13081 - DNA, 824 bp, Homo sapiens
  ENST00000566469
gtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaaggtgggtcacggcagtggccagctctggcctgtagcttagcggctcctcctcttttaagtgttttctgtctggcatgggagctgttggcaatcccagcatggctgtatgttagaatcacccaaggagcttttgagcaatttggctcctgaatgaccatgtcca

SEQ ID NO: 13082 - DNA, 573 bp, Homo sapiens
  ENST00000569000
actacgcgccagaacctgcgccgggaagcgtcgcacagcgactgcatcaccatggagccgagggcaggtgtctccaaacaggacatacgtgaacaaatttggggctacatggaatcacaaaatttagctgactttccccgacctgttcatcacaggatacccaactttaagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccaca

SEQ ID NO: 13083 - DNA, 560 bp, Homo sapiens
  ENST00000568798
actacgcgccagaacctgcgccgggaagcgtcgcacagcgactgcatcaccatggagccgagggcagtaggtgtctccaaacaggacatacgtgaacaaatttggggctacatggaatcacaaaatttagctgactttccccgacctgttcatcacaggatacccaactttaagagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaaggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccac

SEQ ID NO: 13084 - DNA, 565 bp, Homo sapiens
  ENST00000562994
actacgcgccagaacctgcgccgggaagcgtcgcacagcgactgcatcaccatggagccgagggcaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaaggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtcc

SEQ ID NO: 13085 - DNA, 543 bp, Homo sapiens
  ENST00000561522
actacgcgccagaacctgcgccgggaagcgtcgcacagcgactgcatcaccatggagccgagggcaggggtcttatctggcttgccaaaacatcaaagacctagacgtttttgccagaacacaggaagttaaagtggaccctgataaaccactggaaggcgttcggctgctggtgctgcaggtaattccacttccctgagccgagccgagacctggccgccaagggggacaccttttccagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccat

SEQ ID NO: 13086 - DNA, 493 bp, Homo sapiens
  ENST00000564364
ggggctccggggcggctgggaatggggagggacagccgggaccggtgagggtcgaggcggggccaccggggctggcagaggatggggcagaatcaccggaagcggccgaggagtaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtc

SEQ ID NO: 13087 - DNA, 845 bp, Homo sapiens
  ENST00000568037
ccgagggcagtaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaattggtcagtgcctgcccccgtggaccctgcgagatgatgagaacacagggtttcctgcagtgcagggtttcctggactaagcccccttctgtgactgtcgggagacccccaagccacccgtatgcactgatccatacggaacttgtcatagcactgcaggcagatcccaccgccacatcgaatgatcagttactgctggatacgggactgaaaatggctttttcctgagtcttacataaaccgtgttatgagaaccatgaacatattcagcttccctattctttatatgcatgcctgcattagtataaagcggtacacttttgggacattttggttgaagggataattttttagaagcgagtatattgtacataaagatagtggccttcaggattttatattgaataaatatgtcatacagtg

SEQ ID NO: 13088 - DNA, 508 bp, Homo sapiens
  ENST00000561989
ggtggggggcctggcggggctccggggcggctgggaatggggagggacagccgggaccggtgagggtcgaggcggggccaccggggctggcagaggatggggcagaatcaccggaagcggccgaggagtaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaaca

SEQ ID NO: 13089 - DNA, 581 bp, Homo sapiens
  ENST00000565482
ggttcgggtcgaaccagcggctctctcgcccggaatcccgagaaagatgtcaggaaaaataaagataacgagaagacgaggcgggagggacacctgccgtgcacgtgggggagcccgtgggccccttgaggtcggggaaactgaggctcaggaacaggatcggaagccggtttgacctacacgcgggggtcgcttaactactgttaagcggtttcagcatgggctctggaattcctttgtatgttattaagtgggaatcttttgttgcagtaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatc

SEQ ID NO: 13090 - DNA, 571 bp, Homo sapiens
  ENST00000561848
gggcagtggatggcaccaggcaccgtggagcaggagcgtcgctcctcggggaggctctagctgcacaggagcccgccggtgggggtggggaggctcaggcatggcaggctgcaggtcttggggaggcagctaaggcccggcgagaaatagagcacagcagctggtggcccaggtgctaagcccctcactgcccagggccagccgctgtgagtgcggggctccccacgcctacatggaactcgcgctggcccacaagcaccatgcacagcagcagttcccgcccgcgcctctccctccacaccgcccagcaagctgagggagccggcctgggccagtccagaaaggggctcccacagtgcagctgcgggatgaagggctcctcaagcacggccagagtaggcgccaaggccgaggaggcgccgagagggaccgagggctgccagcacgctgtcacctttcaaggggtcttatctggcttgccaaaacatcaaagacctagacgtttttgccagaacacaggaagttaaagtggaccctgataaaccactggaaggcgttcggctgctggtgc

SEQ ID NO: 13091 - DNA, 2185 bp, Homo sapiens
  ENST00000379480
cgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaagtaccttggcctatagtggatgcttatgcctgtaatcccagtgctttgaagggccaaagggggaagatctcttgaggtaagaatttgagaccagcctgggcaaaatagaccccatgtctacaaaaaaactcaaaacataaagaaaaaccataatactgttaatcatgttaaagttaagacttagactgcaacttttaaataaaaattatgaagaatatgagtcattcaataacaatgagcatctgggtacagacagtaaagccctttgattgctgtatgaattccacactatataaacaataagctgatattttaaataga

SEQ ID NO: 13092 - DNA, 598 bp, Homo sapiens
  ENST00000473492
gggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggctcagtctcattccacgggtggtagtcgtgaccctgcacattccacattcctatccttggattctgtgagatcacctggtattctcattatgacttcttctgttaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaatt

SEQ ID NO: 13093 - DNA, 1948 bp, Homo sapiens
  ENST00000379477
gtactcacagttctttcctgatcttccccgccgcctcctgtattgcctctttatggaatcactccatatactgagttacacagcatggtttgcccgtgctgctgccccgcgggctgtcgcttctgacctgcctacactcagaactttccccaaagcatcagagtaatactgttactgtgatgggtaatggagaagtcgtgctgttctcagcgtgttgctttgtcgcccacgctggttgcagtggtgcgatctcagttcactgcaaccttcgcctcccaggttcaagcgattatcctgcctcagcttcccgagcagctaggactacaggatctcagctaaacgggaagcatttttgaaaagtgattgcacaattgagagtgaaaattactgagtcctgaacaggcaacttacattctaataccagctctgtctccatccagccgactgaatagtcgtgattaaatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaatt

SEQ ID NO: 13094 - DNA, 1561 bp, Homo sapiens
  ENST00000239852
cgggtttgtcgggctgaaatgtggcgggtctcggaaggttccgacctcagtaaagagagctaacgtgtattcttctttttcttagcgtgttgctttgtcgcccacgctggttgcagtggtgcgatctcagttcactgcaaccttcgcctcccaggttcaagcgattatcctgcctcagcttcccgagcagctaggactacaggtgtgtgccatcacgctcagctaatttttttggtatttttagtagagatggggttttcccatgttggccaggctggtctcgaactcctgacctcagatgatctgcccgcctcggcctcccaaagtggtaggattacaggcgtgagccactgtgctcggcacattttgatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaaagacagagtcttgctctgtggcccaggctggaatgcagtagtgtaatcatagctcactttaaccttgaactcctggactcaagcaatcctccaacctcagcctcccaagtagctgggactacaggcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtaggcatattgaggaatttgcctgtaggagatactgaaaattattttacctctgatcttgattagaaccatattgtcccatttttttttgaaacttttggtgtatatctactaaacactgtggcataggctcatcaatcacagtggcttactattatagcagagttgttagctaggagaagacagtagaaaggagggaagcatttgcttagggagaaatatgtgaattagagaaaattcccctgaggaacttagatacgtatcttgcctcaaaatcatttttctctattattgaaagcaaaggtatattaaggtttttactttaaataactttataaaataatataagtattactaattaga

SEQ ID NO: 13095 - DNA, 737 bp, Homo sapiens
  ENST00000480434
agaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtaggcatattgaggaatttgcctgtaggagatactgaaaattattttacctctgatcttgattagaaccatattgtcccatttttttttgaaacttttggtgtatatctactaaacactgtggcataggctcatcaatcacagtggcttactattatagcagagttgttagctaggagaagacagtagaaaggagggaagcatttgcttagggagaaatatgtgaattagagaaaattcccctgaggaacttagatacgtatcttgcctcaaaatcatttttctctattattgaaagcaaaggtatattaaggtttttactttaaataactttataaaataatataagtattactaatta

SEQ ID NO: 13096 - DNA, 820 bp, Homo sapiens
  ENST00000452359
ggcgggtctcggaaggttccgacctcagtaaagagagctaacgtgtattcttctttttcttaggaaagtattccatgctacatgtgcaagaaacttggaaaacactgaaaagtagaaaaaatagcaagcaaaagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaat

SEQ ID NO: 13097 - DNA, 863 bp, Homo sapiens
  ENST00000497679
cgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagagacagagtcttgctctgtggcccaggctggaatgcagtagtgtaatcatagctcactttaaccttgaactcctggactcaagcaatcctccaacctcagcctcccaagtagctgggactacaggcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccaga

SEQ ID NO: 13098 - DNA, 618 bp, Homo sapiens
  ENST00000492827
cggaaggttccgacctcagtaaagagagctaacgtgtattcttctttttcttaggaaagtattccatgctacatgtgcaagaaacttggaaaacactgaaaagtagaaaaaatagcaagcaaaaggatctcagctaaacgggaagcatttttgaaaagtgattgcacaattgagagtgaaaattactgagtcctgaacaggcaacttacattctaataccagctctgtctccatccagccgactgaatagtcgtgattaagttacttgacttccttggatatctagatccttaaagttaaagaattatacaagataataatattttcttcaaactttagaaaatgactttatgaaccgccttaagtttgtatgttttcatagctttcaagagcttgtttacacactcaattctagattctagatactttctagaaaataactgacttaactcattcaattgatatatttgttagttgtactcctactcatatgcttcagttaattatatatgttgaacaggtaggaagcagtgctgtttttatttattttaatatgttattcatacatttgaagaattatgttctttctgtaggcagctgaattttttttttttttga

SEQ ID NO: 13099 - DNA, 728 bp, Homo sapiens
  ENST00000498245
tcttaggtactcacagttctttcctgatcttccccgccgcctcctgtattgcctctttatggaatcactccatatactgagttacacagcatggtttgcccgtgctgctgccccgcgggctgtcgcttctgacctgcctacactcagaactttccccaaagcatcagagtaatactgttactgtgatgggtaatggagaagtcgtgctgttctcaggtcgtgttgctttgtcgcccacgctggttgcagtggtgcgatctcagttcactgcaaccttcgcctcccaggttcaagcgattatcctgcctcagcttcccgagcagctaggactacaggatctcagctaaacgggaagcatttttgaaaagtgattgcacaattgagagtgaaaattactgagtcctgaacaggcaacttacattctaataccagctctgtctccatccagccgactgaatagtcgtgattaagttacttgacttccttggatatctagatccttaaagttaaagaattatacaagataataatattttcttcaaactttagaaaatgactttatgaaccgccttaagtttgtatgttttcatagctttcaagagcttgtttacacactcaattctagattctagatactttctagaaaataactgacttaactcattcaattgatatatttgttagttgtactcctactcatatgcttcagttaattatatatgttgaac

SEQ ID NO: 13100 - DNA, 557 bp, Homo sapiens
  ENST00000430347
cgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaaagacagagtcttgctctgtggcccaggctggaatgcagtag

SEQ ID NO: 13101 - DNA, 1447 bp, Homo sapiens
  ENST00000633925
aactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctcc

SEQ ID NO: 13102 - DNA, 1447 bp, Homo sapiens
  ENST00000604952
aactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcgttcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctcc

SEQ ID NO: 13103 - DNA, 1303 bp, Homo sapiens
  ENST00000536684
agccaaacctagccccaaacccattccaccttactaccgaacagctttaaccaaatcatttacccaaataaagtataggcgatagaaattgtaaatcggcgcaatagatatagtaccgcaagggaaagatgaaaaattgcaaccaagcataatacagcaaggactaatccctgtaccttctgcataatgaattaactagaaataactttgcaaagagaaccaaagctaagacccccgaaaccagacgagctacctaagaacagctaaaagagcacacccgtctatgtagcaaaatagtgggaagattcgtaggtagaggcgacaaacctaccgagtctggtgatagctggttgtccaagacagaatcttagttcaactttaaatttacccacagaaccctccaaatccccctgtaaatttaactgttagtccaaagaggaacagctctttggacactaggaaaaaaccttgtaaagagagtaaaaaatttaatacccacagtaggcctaaaagcagccaccaattaagaaagcgttcaagctcgacacctgtcatctaaaaaatcccaaacacataactgaactccttgcacccaattggaccaatctattaccctatagaagagctaatgttagtataagtaacatgaaaacattctcctccgcataagcctacatcagaccaaaatattaaactgacaattaacagcccaatatctataaccaaccaacaagccattattacccccactgttaacccaacacaggcatgcccacaaggaaaggttaaaaaaagtaaaaggaactcggcaaatcttaccccgcctgtttaccaaaaacatcacctctagcattctcagtattagaggcaccgcctgcccagtgacatgcgtttaacggccgcggtaccctaactgtgcaaaggtagcataatcacttgttccttaaatagggacttgtatgaatggctccacgagggttcagctgtctcttactttcaaccagtgaaattgacctgcccgtgaagaggcgggcatagtataacaagacgagaagaccctatggagctttaattcattaacgcaaacaacacttaacaagtccacaggccctaaactatcaaacctgcgtgaaaaatttcggttggggcgacctcggagcacaatccgacctccgagcaacacatgccgagacttcaccagtcaaagcgaattaccacgtttaattgatccaataacttgaccaacggaacaagttaccctagggataacagcgcaatcctattctagagtccatatcaacaa

SEQ ID NO: 13104 - DNA, 4458 bp, Homo sapiens
  ENST00000378017
cccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagaactcgtccagctcggcctcctccgaagcctcggaaacctgccagtcagtgagcgagtgcagctcccccacctctgtcagctcgggctccaccatgggtgcctgggtgtccacagagaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagatt

SEQ ID NO: 13105 - DNA, 4944 bp, Homo sapiens
  ENST00000518547
gcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagatt

SEQ ID NO: 13106 - DNA, 3548 bp, Homo sapiens
  ENST00000520771
tgccctttagagcctggagagggcatgcagagggcctgtggcttgtcccagccggaggttccccttaaggggaccagctgccttctctggggagctgtctatggggtccccgcagccctccagtggaggcagaggccctggctcctgaccgcacttgttttgcataggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccagggtgatgctcttgttctcagtagctggttggggccacctcagcctggctggggatcacattctggccagcaactggggggccaaggcagccttgcagctggagggacctgggctccattccctgacttcctgctctacagcaaagtccctgggaaaaaaaccttgtgtgggaatgagagaggcagaactttctagggtcagagtgggacccaagcaagtcaatagccccctggccccacagacatgtagtgctcacgggggcagaacaggagtgctgttgagccccccccctaaagcaacctgtgtatttctctcctccaacctgcagcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagct

SEQ ID NO: 13107 - DNA, 1822 bp, Homo sapiens
  ENST00000519168
ctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagaactcgtccagctcggcctcctccgaagcctcggaaacctgccagtcagtgagcgagtgcagctcccccacctctgtcagctcgggctccaccatgggtgcctgggtgtccacagagaagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatctttta

SEQ ID NO: 13108 - DNA, 2777 bp, Homo sapiens
  ENST00000325064
caagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagtggacactcttgggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataa

SEQ ID NO: 13109 - DNA, 1711 bp, Homo sapiens
  ENST00000431961
gttgtgttggcagaagagttggtgggggttgtgcagtgtgagaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaa

SEQ ID NO: 13110 - DNA, 1643 bp, Homo sapiens
  ENST00000523587
agccccagtggacttttgctgcaggctcatggttcctgcaggcagattaaccctgtcccttttcttgctactgacatcagctcccctcgttttggtgcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggc

SEQ ID NO: 13111 - DNA, 2166 bp, Homo sapiens
  ENST00000524090
gtgagaaggcaagtcatgaagagttgccccaggacattttccttgtcaggaataagccaggctaaatgtgccctttgggcattgaaaattggaaatggctggtcctagaaaaacagctgccttaaatccttttggggcatgaataaatactttttttacatcctggaaaattgtggttttgactccagcaaggaccccagggaggaggggcacttgttccagaagctggtatttcagcaagccgtgcttgggtctctgttttttgcagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaa

SEQ ID NO: 13112 - DNA, 857 bp, Homo sapiens
  ENST00000523179
agggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcg

SEQ ID NO: 13113 - DNA, 581 bp, Homo sapiens
  ENST00000520094
tttatttataaatattcaggtttcccctcccttgaatgtcaatgccattttgtatctccgcactcatcctgttatattaattttttttccttccccccccctttttttgtttgtttccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgct

SEQ ID NO: 13114 - DNA, 559 bp, Homo sapiens
  ENST00000522722
agcaggaagttcagacctaagacgctgcatcctggacattctgccccctgaagatattgcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaagcgccgcaaagagaagcgagaaccggaccccaacgggggaggacccactaccgccagcggcccacctgcagcagctgaggaggctcagagaccac

SEQ ID NO: 13115 - DNA, 788 bp, Homo sapiens
  ENST00000522118
ggtgggggttgtgcagtgtgagaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctag

SEQ ID NO: 13116 - DNA, 574 bp, Homo sapiens
  ENST00000519226
aatttctagtgctggtcaaatagggcagaaatgaccactgaatatcaagtggttaaaatgcgctaccaacaagtctgggaaccatgattaactttatggcattacaagaggaaaatcctgtaaattctagccttgggtataaatggctgttataaattattaattggtcactgtatttctccctctctcgactgatatttcatgattttccttttcccttcctttccttctccctattaattatagttttactttctcagtaaaaggattatgatattgatggatttggtactgtggctcttcaatttaaaaaaaatttttttaacatgttttgctttcattcccacccccacgatggcagcgttttgatgctttggtggatgttaagctttgatggctaacgcttcccctctcagcacctcattcacccagctggctctgtccccttaggtgattctggacttgaaaggttctgattacagctggtcgtatcagacgccaccctcttcccccagcaccaccatgtccagaaagtccagtgtctgcagcagcctgaacagtgtcaacagcagtg

SEQ ID NO: 13117 - DNA, 553 bp, Homo sapiens
  ENST00000522162
tttccctcgggggctcaaggcactggctgcaagttttcccattgtctgtccctgaagggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattga

SEQ ID NO: 13118 - DNA, 569 bp, Homo sapiens
  ENST00000529463
agggttttggaatggtggctgtgggttcggttcccttggcaccacatctgggtcatgcatgtgcttgtgaccagcttttactccacgtgcaggcagtactcttaaagagtgatttttttttttttttttgtgagacagagtcttgctctgtcacccaggctggagtacagtggtgcgatctaggctcactgcaacctccacctcccgggttcaagcgattctcctgccttagcctcccgagtagctgggattacaggcgcctgctaccattcccagctaaggagtgattttctctgagagggacatttgctgtgaaagtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaag

SEQ ID NO: 13119 - DNA, 345 bp, Homo sapiens
  ENST00000519671
agtcttggcagaggagacaaaaagtaaagagacaatggcaggacgggtgtgacggggcacaggggtctggtttaggcagagaggcgggtcccttggaggcagagcatgggaaatgctgctcagtctaggtgatacccaggcgaggtcttagaggtgcacagaatcctgtgagaagggcaccatcccagcagtggagtgtacagaagctgggaggtgggaccagggagattggatctgctctcaccaggatgtgcatgaggcacagaagcattgaagccaagctgaggcagttttcgagcgctttaattgattgtctgataaacccacttcaagaacagatggaag

SEQ ID NO: 13120 - DNA, 355 bp, Homo sapiens
  ENST00000524243
agcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggcactatcatgggaccacaaaaagcaatatgactctccttgtcctggagcggcttacaattgagtggggaaaatgagaagtataaataaagaatttcaacatag

SEQ ID NO: 13121 - DNA, 707 bp, Homo sapiens
  ENST00000472084
cccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtaagcagatggaggctgactcccagtgttaactgcattctgcacgtggactcttccccttgggtggctgcacaagaagatgcagcttaagttatcagagctgagctgactcgtattttcccattttttaaaactctgtgggattccacatattagaagttgcaactagttttctggataataaagcacatgtgaagaagaatgaaaaaggaagaaaatgaaccactgtttctgcacgagttggcttgatgggttctttgatcactttaatgacgtgctggttgttgaaccttgagctgtgcctttggttgcaatttgcgttttcctccttacgtgggttttccttgtttccttgtggaatgggaagcagtagggatgattggatagaccatttttctgagtttccataaaatgaagaacccttttaaaataagga

SEQ ID NO: 13122 - DNA, 564 bp, Homo sapiens
  ENST00000513404
agcaagagcgccgcaggaaaccacttccacaccactgctcccctctcccccggaagcccttgttgctagtagggggctgcatggcacgcgcccctttgcgtccagagaataccatagtgcgggggagcgccaaccagtgccaggacacttaccgagctgaagagttgacaggttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggag

SEQ ID NO: 13123 - DNA, 537 bp, Homo sapiens
  ENST00000505142
gctagtagggggctgcatggcacgcgcccctttgcgtccagagaataccatagtgcgggggagcgccaaccagtgccaggacacttaccgagctgaagagttgacaggcaggcccagtataatcacaaggattcataaaacggaagagggagacagaagagatggtcagagtgatatgaagtaaaaaggattcagcttactcttgctggatttgtaaatgcaggaagggaccacgagtcaaggaatgcaggtagcttctagaagctagaaaaggttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcg

SEQ ID NO: 13124 - DNA, 549 bp, Homo sapiens
  ENST00000506883
agtagggggctgcatggcacgcgcccctttgcgtccagagaataccatagtgcgggggagcgccaaccagtgccaggacacttaccgagctgaagagttgacaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtaga

SEQ ID NO: 13125 - DNA, 608 bp, Homo sapiens
  ENST00000515141
catttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttgga

SEQ ID NO: 13126 - DNA, 555 bp, Homo sapiens
  ENST00000504724
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgtgagtattggatgaaggaattaagatagtcccactgttaaaaatgcaaaacaacgaagaaaggctcctaatttttctgtgttgaaaatgagagaaaaacatctcttgcctatattatttttaatttatacagaaaattaccatatcacatgattttacataactcaagtggaaaattaaattcaaaaagcaggcccagtataatcacaaggattcataaaacggaagagggagacagaagagatggtcagagtgatatgaagtaaaaaggattcagcttactcttgctggatttgtaaatgcaggaagggaccacgagtcaaggaatgcaggtagcttctagaagctagaaaaggttctgaagagggtcactccctcactggctgccattgaaagagtc

SEQ ID NO: 13127 - DNA, 551 bp, Homo sapiens
  ENST00000511610
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgcaggcccagtataatcacaaggattcataaaacggaagagggagacagaagagatggtcagagtgatatgaagtaaaaaggattcagcttactcttgctggatttgtaaatgcaggaagggaccacgagtcaaggaatgcaggtagcttctagaagctagaaaaggttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttctt

SEQ ID NO: 13128 - DNA, 554 bp, Homo sapiens
  ENST00000505094
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgcccagtataatcacaaggattcataaaacggaagagggagacagaagagatggtcagagtgatatgaagtaaaaaggattcagcttactcttgctggatttgtaaatgcaggaagggaccacgagtcaaggaatgcaggtagcttctagaagctagaaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaaga

SEQ ID NO: 13129 - DNA, 3154 bp, Homo sapiens
  ENST00000511045
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatg

SEQ ID NO: 13130 - DNA, 4037 bp, Homo sapiens
  ENST00000265517
acctacgtttaatcattaatagtgagcccttcagtgaacttaggtcctgattttggagtttggagtctgacctttccccaaagataaacatgattgttgcaggttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtccttattttccactaaacacagacacatgaaatgaaagtttagctagcccactatttgttgtaaattgaaaacgaagtgtgataaaataaatatgtagaaatca

SEQ ID NO: 13131 - DNA, 1155 bp, Homo sapiens
  ENST00000422897
actccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtaaaggggcgtttagattccacaactttttctccaacttcatatttttcttcccttcagtagatattattttgaggtaatcacattgtaactacttttatggtaaatggaatttcttcaagaactaaagaacagaggttgtaaattaaatgtttccaaactgaatcaatgccctgagttcccttacatttactagccaatttgtttcctatttttctggaaatctttatagtggaatgaagtatttatttattgatgaaaggcattattaaaaggtaaatttctcatcaaattataagggattacaaacgtaatgtaacaaagcaagtcatcaaagcatgattggatgaattcaggaaaggagacaaattatgagactgaaatgatccaactgagattagtaatattgatttgttatgagattatcgatatctggctaaagtacaaggttaaagattttaaaagggtatgacaagtctaaagtagagtttttttaaagcctttagaaattattttaaaactatgacatggaaaagccttttatatattaaaataatgattgaacactttataatatatatttgaaaatctgttttaaaaattctatgtgtgcattacttatggcttgattctagtcaattgaaatggtctaaataaatttggaattgagaaacaa

SEQ ID NO: 13132 - DNA, 4092 bp, Homo sapiens
  ENST00000457717
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtccttattttccactaaacacagacacatgaaatgaaagtttagctagcccactatttgttgtaaattgaaaacgaagtgtgataaaataaatatgtagaaatcata

SEQ ID NO: 13133 - DNA, 854 bp, Homo sapiens
  ENST00000563915
aactcccaagccccacccctgggcttggcctgccttgccctgccgggaagtgatccccaaggcagggtgagagttccccatctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatcc

SEQ ID NO: 13134 - DNA, 2870 bp, Homo sapiens
  ENST00000357402
acccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaacactt

SEQ ID NO: 13135 - DNA, 589 bp, Homo sapiens
  ENST00000566859
aaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctga

SEQ ID NO: 13136 - DNA, 546 bp, Homo sapiens
  ENST00000563096
gttccccatctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggtgggtgtgggggctgggctgtgggggatccttggggatgtgggggcctgtttggctggcatgatggtccttatcctcctccctcttcccaagcaggagtggccctcgcttgggcgatagagaggtttctctctcatttggtgtcctctttggtagtggagacctggtcccaggtcctcacacctcttctcatcttcctgcagggtactgtttgcccccatgcgcatggtgaccgtccccccacgtcactactgcacagtggccaaccctgtgtctcgggatgcccagggcttggtgctg

SEQ ID NO: 13137 - DNA, 548 bp, Homo sapiens
  ENST00000566066
atctgaggcgtttgttgcagctacctgcacttctagatgtttcggccctgcggagaaccctccaagggagcagtggaaaaagcttcacttggcagtaaagcccctacttgctgttccatccctgcagctggggtgaaataagccactgaccagtaaacaactgaggcttaaaccagcatgccagctcaggctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccagg

SEQ ID NO: 13138 - DNA, 525 bp, Homo sapiens
  ENST00000562463
atctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaagg

SEQ ID NO: 13139 - DNA, 548 bp, Homo sapiens
  ENST00000563558
atctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggccatccctctagacgagaacgagggcatctatgtgcaggatgtcaagaccggaaaggtgcgcgctgtgattggaagcacctacatgctgacccaggacgaagtcctgtggga

SEQ ID NO: 13140 - DNA, 557 bp, Homo sapiens
  ENST00000565830
gaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggctccagagcctaccagaagtgcccagccagtctggcattaaatgacatgtgccaaggttaagcagttcattcacccggtgccagacactggtgggcagtgccaaagcagcagtgacaagcccagg

SEQ ID NO: 13141 - DNA, 549 bp, Homo sapiens
  ENST00000569887
aggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtgga

SEQ ID NO: 13142 - DNA, 211 bp, Homo sapiens
  ENST00000565164
gagcactgggtcggccctcgggtgtggctgtttgggcaggacagccctcttcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagg

SEQ ID NO: 13143 - DNA, 658 bp, Homo sapiens
  ENST00000570234
agcactgggtcggccctcgggtgtggctgtttgggcaggacagccctctgtatgtagccttgagcagctgtgggaaggtctgggggcagggccgcatcaccgaccttacgtccaacctcaggactgcctggagcaagagccctggggttggggacaaaggaggctgcctggacctggtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctgg

SEQ ID NO: 13144 - DNA, 408 bp, Homo sapiens
  ENST00000566252
attcctgaacaggccaagcactgggtgaaactactcaggattcagaagcagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaagg

SEQ ID NO: 13145 - DNA, 811 bp, Homo sapiens
  ENST00000566554
caactgcaggagctgaggatgggagagaactggggacgagggggccagagtgatttgcagtgttagtaatgcagctggttctatggaaggctcagttccatctgggatccctttatgagcagtggactaggtcttcacattcagcccaggattactaaagcataggaaagaggcagggaacatagacacagctcatgtaaacattccttttgtttatggccgaatcctagccactggactacctgaggcatacagatattctttggctatgggctgacatttgaatacagctggggcctcaggattctctgaaataaagggctgcctccctctggaggagccaggcagctcctcagagcagctgcccattgcgtgctggacaaggccatgtcaccacctccatggctccccagtttcccagcttgctgtatctctccaccgtaagagactgggagcaccttgatctgaagctctttgcagtgccggtggcagtgtagggggaagtagttgatgggagtgagggaaaggaattggcaaggaaccctgggcctctgtggctcactgcatcaagcagttcttggcaaaggctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcat

SEQ ID NO: 13146 - DNA, 2091 bp, Homo sapiens
  ENST00000569612
cccaggctgaagtgcagtggtgcagtcatagctcactgaagccttaacctcctgggctcaagtgatcctcccacctcagcctcccgagtagctgggactacaggtgtgcgccgccaccatgcctggctacactttttttttttttttttttttttagagatgggatcttgctatgttgcccaggctggttcttgaatgtctgaggtcaagcaatcctcctacctcagtctcccaaagttctgggatgacaggtgtgagccactgtgcccggcctccaccccagtcttatttcaggacatacagagatggatgttgtggacccgcctccagagcatcaggcttggccctggggtcacagcactgatggttctgtgtctccaccttcttccccactaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaagcctcctgtagccccagagaggcgctttcctggtatcttttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggtacagtggctcacacctgtcatcccagcactttgccaaggtgggtgaatcgtctgagcccaggagcttaagaccagcctgagcaacacagtgagaccccatctctacagagaatttaaaaattagcctggccttggacacacacctgtggtcccagctactcagaaggctgaagggggagaatttcttgagcccaggatgtggaggctgcagtgagctgtgactgcaccactgcactccatcctgggccacagaggtactaccccgaggtgctaccattcccactttttttttttttttgagacggagtcttgctttcttgctgttgcccaggttggagtgcagtggcgcgatctcggctcactgcaagctccgcctcctgggttcacaccattctcctgcctcagcctcctgagtagctgggactacaggcgcccaccaccatgcccagctaattttttttttttttgtattttttttttttttttttttagtagagacagggtttcaccatgttagccagggtggtcttgatctcctgacctcgtgatccaccaggttcggcctcccaaagtgctgggattacaggcgtgaaccaccgcacccggccattcccactttctatatatcaaaactgggatgcagaatgcaggttgcttgccctggggtgtggccaggcagggcgaggctgggacctgcatccaggcactctggcttctccagtaaaccaaaggacatccacaactctaacagaggcagttctgctgcctgttttagcagaaggacaaaagttggtctttggagcttagagaaggcagaacaggctgttggcatagcagcaacttgggcatcttaggaggccaaggtgggcggatcacttgaggccaggagttccagactagcttgggcaacatggtgaaacaccatctctacaaaaaatacaaatattagccgggcgtggtggcacgtgcctgtaatcccagctactcaggaggctgaggcatgagaatcacttgaatccaggaggctgaggttgcagtgagctgagatcacagcctgggcaacagagggagactccgtctcaaaaaaaaaaaaaaaaaaaaaaaaa

SEQ ID NO: 13147 - DNA, 575 bp, Homo sapiens
  ENST00000563123
caggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaagcctcctgtagccccagagaggcgctttcctggtatcttttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggggaagaatggctggtcaccacagtaggggcgtacctcccagcggtgtttgaggaggttctggatttggtggacgccgtcat

SEQ ID NO: 13148 - DNA, 674 bp, Homo sapiens
  ENST00000570061
ttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggtacagtggctcacacctgtcatcccagcactttgccaaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctg

SEQ ID NO: 13149 - DNA, 561 bp, Homo sapiens
  ENST00000568068
gaaacagcacaggactggggaggtaccattggaagcacccgcaaccctaaaggcactgaccctaacctcacgtctccccactagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtg

SEQ ID NO: 13150 - DNA, 2925 bp, Homo sapiens
  ENST00000395353
aactcccaagccccacccctgggcttggcctgccttgccctgccgggaagtgatccccaaggcagggtgagagttccccatctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaacactt

SEQ ID NO: 13151 - DNA, 120 bp, Homo sapiens
  ENST00000629059
atggcaactgaagagttcatcatccgcatccccccataccactatatccatgtgctggaccagaacagcaacgtgtcccgtgtggagtgtcccgccgcactggggaggagtggctggtaa

SEQ ID NO: 13152 - DNA, 860 bp, Homo sapiens
  ENST00000435990
aaagaagaggaagaagattatttcaggtagagggaagagctcatgaaaatgccatggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggattttgtattttgtatttaacttgcattcaaaaaacaggatctcagttctcctttcttgtaaaaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccacttggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacag

SEQ ID NO: 13153 - DNA, 5587 bp, Homo sapiens
  ENST00000264444
gagtcggggataaacactccgcggcggtggcggctgctgctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccacttggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgacctttgcactgtttgtctggtccttttcagtttgattgcatataaatgtggaacttgatagatctctatatttttaatgcacttgtgataaactggcagcagggttagacattactttcaaagcttgaggtagaccgagtcagcatgctagacaggcttctctctctaaccaaaactgtaatcttcaggaccagcaaactcagcccaaggcagctaatccccccaaccccatcctccgcgccccgtgcggctgatcggcagccctgattcgccaatttgtcctctctcattcactgatccaccagcctgactgctaagagctatagtctttttagttgttttgtctttttaagcaagatgaaaacctttctattagggattttggggttgggaggggatgggcagagatataaaccccagcctttaagactttgacaattgtacgtaaatacagatgtgtataaatataggcacatgcatatttttatgtgaaagttgattttaaaaaactaaaaaaatctaaactgcactcttattgataccatcataacgcaagtgggaaaaataagagtacgcagtctaatttaatttcatgcagtgggaaaatatatatgtgtgcttctgtaacatcctgaaaacatagctttccatcccctgttggctttgaatggtgggccgagcacccaggtcgtctgtattttggttttcttttgctaagcagagatcttgaattcttcaaggtgctgatagcaactgctggctcctttctgtagtcacacacctaatgctagtttagtgattcaaaatgcatcacatttttaggcaggacctagattttccctgtcaacctaagatgaaaataatttcagtgttgattcagaactgaacattaagtaggccctcgtcctgcagttggccacttgagtgttttgttttgtttttattttttaaggtgggcattttcctttaacctctactttttcaaaagcaacaaaggggcctcaacctgagtttcctatgggcctctcttctgcatccccaaagcggccaagagcaaatcctgggggataagaaaaaagtgtaaactaggtaggattgtgatgctcaaaataaccatctagcaatatcttggagcttgagaatagattttgtgggcttatttcttcttgcctcttccccatcctttcaagagagaacttatttttgaaaagtatctatatatacacacacacacacacacacacatattattatttaggtttttataccatactgtattggcgagaataccactatcattgtcctttacagtctatttcttcccccaagtcttggtctttttttattttctattttttcatgaaccacacaggagactttaacatcctggtcttttctgtttcttctttgtttccccaagtttgtctgtccccctttgccttccctgagtgttgaacatcaggtagtaaaaggctaaacgcaatttcttgcatgtcaatctattctttttctatgtttgactctgatgcagtgtgtttagcgtgtctagtagctggctactcctatttaaaaactcttcctggtagaagacaacccaaagacccttttcgatgaggtggtttctcattctacatcctctgatctctatagactgtaggatgctttgctttcaaagataactgggttagagggtggggtgtgcaataggtgatttatcatggtttttttcattatcaatattacatggatgattttctcagattcttctgaaagaagaaattgacaggcactgctagattcagctattgaatggctgaagagattgagtatttgaccttctctcaaaatcataaagtgagaattcataaggcacccaatgttaagatttatccagatttttacattttgatttcttctctctgtggggtggcaagttgagggagcattcttcattttagcttttacctgacaaccaaacttgcctttaccccatccctagaattggtgctcttggaatattgctgttaccatcatttttggggggccatcttcctaatgctacacacagcctgacaggggagcagcagatgaaagggtatgctattctgtttccagatgtttctttatgtaaatatgacgccaatgtaaatcctgtgtcaagatcatagagaatggtgctttttactacagttagcacatgcatttttagaaactactacatgttttagagaatctttgctgtgtatatgtaaactgtattgttcaactgttaacaaataataaattatttcattattaaagaaa

SEQ ID NO: 13154 - DNA, 982 bp, Homo sapiens
  ENST00000409442
gctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagacgggctcatcttcgcttgtgcctggagaagttgaaggggctggtgccacttggacccgaatcaagtcgacacactacgttgagtttattaacaaaagccaaattgcacataaaggacaagtacccccagcactggcgatgctgaagagtcagacgaagccaggagtcactggccagtcgacttcctgtctcagggagaagcttgatgagtggcaccgaaaggcgtctgaggaagtgtggcgcattccactgctagaagggaagatgcgggggccattgcccatttagagatctccctgtggggcccaacaactacccctttgacttgcagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagca

SEQ ID NO: 13155 - DNA, 598 bp, Homo sapiens
  ENST00000410000
gtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcaggtaatttggtaaatacttctttctgtcttttagattatattgtaggtgacacaaactgctgaatgtaagttttctgttgtgattataaccctataaaattacattgtggccgtcatgattcagtaatgtacacatggacttaagccattgcaggaagctgtttctgtttgggttgagggaactgaaaagaaaaatagaaatgttttacatttctttatgaacttta

SEQ ID NO: 13156 - DNA, 490 bp, Homo sapiens
  ENST00000465446
gagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattagaattggtgctcttggaatattgctgttaccatcatttttggggggccatcttcctaatgctacacacagcctgacaggggagcagcagatgaaagggtatgctattctgtttccagatgtttctttatgtaaatatgacgccaatgtaaatcctgtgtcaagatcatagagaatggtgctttttactacagttagcacatgcatttttagaaactactacatgttttagagaatctttgctgtgtatatgtaaactgtattgttcaactgttaacaaataataaattatttcattattaaag

SEQ ID NO: 13157 - DNA, 5580 bp, Homo sapiens
  ENST00000540449
aagagaaggggctgggggcggggagatggtgagtcggggataaacactccgcggcggtggcggctgctgctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagacgggctcatcttcgcttgtgcctggagaagttgaaggggctggtgccacttggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgacctttgcactgtttgtctggtccttttcagtttgattgcatataaatgtggaacttgatagatctctatatttttaatgcacttgtgataaactggcagcagggttagacattactttcaaagcttgaggtagaccgagtcagcatgctagacaggcttctctctctaaccaaaactgtaatcttcaggaccagcaaactcagcccaaggcagctaatccccccaaccccatcctccgcgccccgtgcggctgatcggcagccctgattcgccaatttgtcctctctcattcactgatccaccagcctgactgctaagagctatagtctttttagttgttttgtctttttaagcaagatgaaaacctttctattagggattttggggttgggaggggatgggcagagatataaaccccagcctttaagactttgacaattgtacgtaaatacagatgtgtataaatataggcacatgcatatttttatgtgaaagttgattttaaaaaactaaaaaaatctaaactgcactcttattgataccatcataacgcaagtgggaaaaataagagtacgcagtctaatttaatttcatgcagtgggaaaatatatatgtgtgcttctgtaacatcctgaaaacatagctttccatcccctgttggctttgaatggtgggccgagcacccaggtcgtctgtattttggttttcttttgctaagcagagatcttgaattcttcaaggtgctgatagcaactgctggctcctttctgtagtcacacacctaatgctagtttagtgattcaaaatgcatcacatttttaggcaggacctagattttccctgtcaacctaagatgaaaataatttcagtgttgattcagaactgaacattaagtaggccctcgtcctgcagttggccacttgagtgttttgttttgtttttattttttaaggtgggcattttcctttaacctctactttttcaaaagcaacaaaggggcctcaacctgagtttcctatgggcctctcttctgcatccccaaagcggccaagagcaaatcctgggggataagaaaaaagtgtaaactaggtaggattgtgatgctcaaaataaccatctagcaatatcttggagcttgagaatagattttgtgggcttatttcttcttgcctcttccccatcctttcaagagagaacttatttttgaaaagtatctatatatacacacacacacacacacacacatattattatttaggtttttataccatactgtattggcgagaataccactatcattgtcctttacagtctatttcttcccccaagtcttggtctttttttattttctattttttcatgaaccacacaggagactttaacatcctggtcttttctgtttcttctttgtttccccaagtttgtctgtccccctttgccttccctgagtgttgaacatcaggtagtaaaaggctaaacgcaatttcttgcatgtcaatctattctttttctatgtttgactctgatgcagtgtgtttagcgtgtctagtagctggctactcctatttaaaaactcttcctggtagaagacaacccaaagacccttttcgatgaggtggtttctcattctacatcctctgatctctatagactgtaggatgctttgctttcaaagataactgggttagagggtggggtgtgcaataggtgatttatcatggtttttttcattatcaatattacatggatgattttctcagattcttctgaaagaagaaattgacaggcactgctagattcagctattgaatggctgaagagattgagtatttgaccttctctcaaaatcataaagtgagaattcataaggcacccaatgttaagatttatccagatttttacattttgatttcttctctctgtggggtggcaagttgagggagcattcttcattttagcttttacctgacaaccaaacttgcctttaccccatccctagaattggtgctcttggaatattgctgttaccatcatttttggggggccatcttcctaatgctacacacagcctgacaggggagcagcagatgaaagggtatgctattctgtttccagatgtttctttatgtaaatatgacgccaatgtaaatcctgtgtcaagatcatagagaatggtgctttttactacagttagcacatgcatttttagaaactactacatgttttagagaatctttgctgtgtatatgtaaactgtattgttcaactgttaacaaataataaattatttcattatt

SEQ ID NO: 13158 - DNA, 4056 bp, Homo sapiens
  ENST00000337190
atcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 13159 - DNA, 4228 bp, Homo sapiens
  ENST00000513372
aacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccag

SEQ ID NO: 13160 - DNA, 624 bp, Homo sapiens
  ENST00000513380
gctgcccttcgacggcgacttcgccagggagaaaacaaaggcggccggcctggtgcgcaaggccccgaacaacaggtcttcacacaacgagctagaaaagcacaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggac

SEQ ID NO: 13161 - DNA, 522 bp, Homo sapiens
  ENST00000515378
gcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgcct

SEQ ID NO: 13162 - DNA, 561 bp, Homo sapiens
  ENST00000510822
gcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacagcggcatcctgggaggcccgggagccctggctggcctgtggggtcctgcctggacacggaaggtggcctggagctgggagcgaggtccccctgcctcgttatcctccaggcagatgctgtggcacaccctgtggtgctgggaattgtgtgcccgcgtctgaatgggcaagacaggtcttcacacaacgagctagaaaagcacagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtc

SEQ ID NO: 13163 - DNA, 1171 bp, Homo sapiens
  ENST00000474033
ggcactgcccccaatgtgagtctccttcccaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgatttttaga

SEQ ID NO: 13164 - DNA, 2273 bp, Homo sapiens
  ENST00000309212
gtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 13165 - DNA, 2001 bp, Homo sapiens
  ENST00000445648
agagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagcctcctctcctcccacagattacaaaaacaacatcctgaaggagagggcggagctggcccacagccccctgcctgccaagtacatcgacctagacaaagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttt

SEQ ID NO: 13166 - DNA, 2728 bp, Homo sapiens
  ENST00000477278
aagaaggctggcggtgtttcctcttagaggggagaaactcagcctgggtaggagacccagccccacgcagggaaaactgtgctaacgcttccgatgtgcgtggcaggtgcggcggcggcgaatacggtttgtcctcgagcctaaccctgtctgtgttggtgtcagcagtggcccccctaccacacacacagggtccctggcgtcccaagaccactcctggcagccccgccactggctgcgcctggaagccgcgtcctcaggcctcgcctggcatttgctgtcacagaggttgcttccttgggtccgtccgtcctcgcccctccagcctgggcgccccccgacccctgtctcattccctccaccacatgcagcacagtccaggaggctggggtccaagagggccatggctggcacccggcttagtgctgagtccccagtgcccagcaagcctggcacccaggaggtggtcagcaaacgcttctgaacgacaggaagtgggactcttcagccatcgatgatccgctgtgcggccacaggctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttt

SEQ ID NO: 13167 - DNA, 975 bp, Homo sapiens
  ENST00000473097
gtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaaggtgagcggcgggggcgacctcagcccatctcagagccctgcctgtccccattccacctcacctgggaccaacgatggcaggcaccagccaggcccggggcccctgccacctcaggctcagaaatccctggggagtcctgcgggggggtctgccctgtgtctcccactgtgatgagggtggaggacagccgccaacccgttggcgcccttggcttccagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggag

SEQ ID NO: 13168 - DNA, 846 bp, Homo sapiens
  ENST00000478517
gagtctccttcccaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaaggtgagcggcgggggcgacctcagcccatctcagagccctgcctgtccccattccacctcacctgggaccaacgatggcaggcaccagccaggcccggggcccctgccacctcaggctcagaaatccctggggagtcctgcgggggggtctgccctgtgtctcccactgtgatgagggtggaggacagccgccaacccgttggcgcccttggcttccagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccaggg

SEQ ID NO: 13169 - DNA, 1001 bp, Homo sapiens
  ENST00000476718
gcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctccca

SEQ ID NO: 13170 - DNA, 405 bp, Homo sapiens
  ENST00000464351
gcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccgtgagtgcttcccccccgccccccagctcccgcccctcgaccctcgaccgccgccccggcccgcgcgccgctgaccgcgccccctccgcagccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccgg

SEQ ID NO: 13171 - DNA, 339 bp, Homo sapiens
  ENST00000460473
gcggccgcctggagctctcggcctcggccttcgacgacggcaacttctcgctgctcatccgcggtgcggggaccggggaccggggccgcggggtcggggcaggggtccggggccgcggggtcgggggcaccgcaaggctcacgcgcggcttcctcctgggtgcgcagcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgct

SEQ ID NO: 13172 - DNA, 2231 bp, Homo sapiens
  ENST00000342753
atgtcctcggaccttcttgtccctccaagggtgcggtcaccacccctccccaggcctgaccggtgaggggctgggcctctgctcccacactgcccctccccagcaggccagcaacgatgggggaggccaaggggcccggcaggagccagagggggcggtccccagaccgtagacaggcccaggcctccgtgatgtcaccgcgggtgctaaggagggggagggggtagggctgtttttctggagagagacttagagccgagtgggacaaagcctggggctgggcgggggccatggcgctgccatcccgaatcctgctttggaaacttgtgcttctgcagagctctgctgttctcctgcactcagcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgatttttaga

SEQ ID NO: 13173 - DNA, 3834 bp, Homo sapiens
  ENST00000547405
agatgtgagaaaggtccccatagctgtcaagttcctgcatccttgtgctgaagaaagggaggtgccatcatgattgatgttcagaggcagtataaaagcactgggtttctccccaactgcttgtcacaccgacctgcaccatctctcgcctgcctgtggggtttctgtcaactagtcgtggagggaaggagactctttaaagaataacatcttattgtggccatgccagaacccactaagaaagaggactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagag

SEQ ID NO: 13174 - DNA, 3861 bp, Homo sapiens
  ENST00000452455
ttgtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctc

SEQ ID NO: 13175 - DNA, 654 bp, Homo sapiens
  ENST00000547627
gtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcaggtgagcgcaagcccagagaaggcatcctgacctcatcctaatacaatcactaatgagctcatttcttgaagctgtattgattctaatccttgtcttattcagattgtagtttttacggcaatctttcattacgtttcctcttacaagaaaactaatgtattgagaaacaattaattttgcatgatacacacgcattcaaggatctagccaaaaataccacaggtttgttctatcatttttaatatttagcaaatacacagagatcaatcttcattttggggatgtactaaagttagataataattcacatttttatagaactttacatacagataataaaacattttcaaatgcatcctatcagctgtagctcctg

SEQ ID NO: 13176 - DNA, 3644 bp, Homo sapiens
  ENST00000392934
gtcacaccgacctgcaccatctctcgcctgcctgtggggtttctgtcaactagtcgtggagggaaggagactctttaaagaataacatcttattgtggccatgccagaacccactaagaaagaggatgaagaggaagtctccccgcctagcgccttgcctccagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttg

SEQ ID NO: 13177 - DNA, 3749 bp, Homo sapiens
  ENST00000547509
gtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagaga

SEQ ID NO: 13178 - DNA, 3871 bp, Homo sapiens
  ENST00000361685
gtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaa

SEQ ID NO: 13179 - DNA, 975 bp, Homo sapiens
  ENST00000550501
gtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaaggtgagtaaaaacactcactcacacacgtttgggctgcaaatacagagggtccatcccagcatgatttggcctccacgggtgctgtgagctgtgagctttaacctaactcctactgagaagttggatggtgaccattgtgataagttgagaataataaaaataatacactgtgtttatataatcctcttgtgttaatctaatttggatggcacttcatatatattagggggacaattcttatgaaacctttcaaattatgtaaaagttattatgtccgcattttacagtgtggaggctgagcctccatccaaggggctgaagaatttgtgaggctttttcctatatagtgaaggtcaaacaaacccacatcttctttatgagagtggggagtggatccatctctaccctggaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtca

SEQ ID NO: 13180 - DNA, 4031 bp, Homo sapiens
  ENST00000549145
gtcacaccgacctgcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacata

SEQ ID NO: 13181 - DNA, 3777 bp, Homo sapiens
  ENST00000553190
gcaccatctctcgcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctca

SEQ ID NO: 13182 - DNA, 3569 bp, Homo sapiens
  ENST00000545503
gcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaagg

SEQ ID NO: 13183 - DNA, 3512 bp, Homo sapiens
  ENST00000536007
gcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaagg

SEQ ID NO: 13184 - DNA, 3533 bp, Homo sapiens
  ENST00000541119
gcctgcctgtggggtttctgtcaactagtcgtggagggaaggagactctttaaagaataacatcttattgtggccatgccagaacccactaagaaagaggaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaagg

SEQ ID NO: 13185 - DNA, 3899 bp, Homo sapiens
  ENST00000361466
gcctgcctgtggggtttctgtcaactagtcgtggagggaaggagactctttaaagaataacatcttattgtggccatgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtgatatatcaaggagtaaatacccctggacaaccagtcttcctggaggggcagcaacagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctca

SEQ ID NO: 13186 - DNA, 3934 bp, Homo sapiens
  ENST00000551300
cctgcctgtggggtttctgtcaactagtcgtggagggaaggagactctttaaagaataacatcttattgtggccatgccagaacccactaagaaagaggcaatttcaaagtatccccgaatcaaacatgaatgttgaagtcaactacccagactgaagttgcttttaaaaaatgcttggacacaaaaacaaataaaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataaggatttttgaatgtataatatcatctaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctc

SEQ ID NO: 13187 - DNA, 3426 bp, Homo sapiens
  ENST00000550270
atgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagtcattgcacaataa

SEQ ID NO: 13188 - DNA, 583 bp, Homo sapiens
  ENST00000552198
atatgcttgtactttctacacagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccag

SEQ ID NO: 13189 - DNA, 968 bp, Homo sapiens
  ENST00000550312
actcctatttcttgtttcagatgaagaggaagtctccccgcctagcgccttgcctccagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtaggtgagaacaaagtgatggagtgagacattgtggcctggaagtctttcagacacccactcagagaagtcaagtttaaagtggatgttcttcagagaatttttcatttctgaaaatgtgttttgcttatagaatataacagagttgactagaaagagagaaacaactgcatactaatcttttaaagcctttaacagttgcttttaaactttctttttaaatgtttcatgactcttcacctatttttttttaaatggggacgaagagatatgaaaactgagacataagacaaatacctagaaacctctaagactgcacatatgatttggtagaagtctgaaggtatacacattgtaagaggcagacctactttaatgtattatttatgatgtactgtatttctgcaagtctaagacaccactgct

SEQ ID NO: 13190 - DNA, 770 bp, Homo sapiens
  ENST00000548834
aatgtagttgtatcgatgtggccttatagtccatcacctagaaaaacaccaagagtactgcttgaatacactggccaccattgtttacctgttaggggacaggcaagatggggaagcaaaggaattattgccatcaaagagagaataacagcttacctggaaagttccactatttctaagaattacataatgttcatttgccccatcatggaagagatacccctgtaagaatgggaatctgttcccctctactgatggctgctgggggcagaaagaatgatgttgtatttatctaggtttattagacaaagaaaagctacagcgttggtgagaacaacaaatccaggtaagactgcctaagaagagcctggccctgaaataatccttttcctcctttctgctcatcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcattt

SEQ ID NO: 13191 - DNA, 574 bp, Homo sapiens
  ENST00000550812
agccatttggggttgctggtcattagctctccaaagtcatattcccttttggtgccctttaaacatcactgaaacacaattgctaaataacttcccacatcacaatcattacagagggattagatctgccttgtccttagacaactatcgaagtgcatttttcctaagcccaaagctgaataaaatgagtctagcagattactactgttccaaggtctgatgctctcctcttcttactttagtttctccttaaatgacatatttcaaattgaccaaaaactgaggtcatttttatcagacactgaactatacttacaagatattgtgactcgccatttttgacttggatttctaccagccaacatcttgagtcttgtaaaactctttgattcagttctgcggaagttcactttgtagttaaaaacaacaaccacaacaaccatattcaacatttagacaataatttcttggttaacattttcaagacttccctgatcctccagtggcaccgactgtgacagaggtgggagatgactggtgtatcatgaactgggagcctcctgcctacgacgga

SEQ ID NO: 13192 - DNA, 569 bp, Homo sapiens
  ENST00000548298
aaacagtggcccaagacttcacctccaggaaaactctttggacaccaaactttaacacagatcctcgaagtgaaggaaggaggttacgaagcacatttgggaaatcaggaatgtgaacgcaaatgcacctcccctggaggaaactcactatggagatgaaacttcctatgaagagaaaactgctgaaaaagaaatcccaggtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatc

SEQ ID NO: 13193 - DNA, 440 bp, Homo sapiens
  ENST00000548532
ttcacctccaggaaaactctttggacaccaaactttaacacagatcctcgaagtgaaggaaggaggttacgaagcacatttgggaaatcaggaatgtgaacgcaaatgcacctcccctggaggaaactcactatggagatgaaacttcctatgaagagaaaactgctgaaaaagaaatcccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccag

SEQ ID NO: 13194 - DNA, 1902 bp, Homo sapiens
  ENST00000549608
ttcagaacttggaccctggtaaaacagggctggccttatcccaagggcctgcactcccagtcttgaatgagggagccccactgtgggagcaccgtgttccctggggacccaagagaatcctcccctgctggggtggcagagacaggcacaaggatagactgtctcactgtgcgctgctcccccgcagattccaggacctgctcctctgttttcttcagggtcttgctttgttcttctctatctcttcttcccaccactggaggtgtcccagcctcctttctcctcttctctattcttttcttttttctcctcttctctgtggcaggtgcctcaggtcagaagccacagtctgcacagagcaggctgtgctctcctgaggaacccccctaacaccgtttggtctcttccgtcactgctctgaggacaaatctctttgcacactttgcatactttactaacagagaatgctgactgctgatacgatattattctggtgtgaaagtgggtgtctttaattaattttaatgacggattctcaaaggtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaaggtgggctctccttctgcagactcctcttgcaaggcgtacctccaaacataattgattcgtatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagag

SEQ ID NO: 13195 - DNA, 661 bp, Homo sapiens
  ENST00000550514
ctcttccaaataagctttccttgtggcttacgctgttcttcacttggatttgaacccgatcagcggctttcctttcaccaaaggatcttatttttgtaatttgtcggactttgcaagaattgtgatattctcagccagccctttcttcataagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggagga

SEQ ID NO: 13196 - DNA, 3256 bp, Homo sapiens
  ENST00000397332
tgcgcctgcagctcgcgctcccgcgccgatcccgagagcgtccgggccgccgtgcgcgagcgagggagggcgcgcgcgcggggggggcgcgcttgtgagtgcgggccgcgctctcggcggcgcgcatgtgcgtgtgtgctggctgccgggctgccccgagccggcggggagccggtccgctccaggtggcgggcggctggagcgagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcggagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcactggctactaactgaccaaaaagcctgacagttctgtcttacgaagacacaagtttattttttaacctccctctcccctttagtaatttgcacattttggttatggtgggacagtctggacagtagatcccagaatgcattgcagccggtgcacacacaataaaggcttgcattcttggaaaccttgaaacccagctctccctcttccctgactcatgggagtgctgtatgttctctggcgcctttggcttcccagcaggcagctgactgaggagccttggggtctgcctagctcactagctctgaagaaaaggctgacagatgctatgcaacaggtggtggatgttgtcaggggctccagcctgcatgaaatctcacactctgcatgagctttaggctaggaaaggatgctcccaactggtgtctctggggtgatgcaaggacagctgggcctggatgctctccctgaggctcctttttccagaagacacacgagctgtcttgggtgaagacaagcttgcagacttgatcaacattgaccattacctcactgtcagacactttacagtagccaaggagttggaaacctttatatattatgatgttagctgacccccttcctcccactcccaatgctgcgaccctgggaacacttaaaaagcttggcctctagattctttgtctcagagccctctgggctctctcctctgagggagggacctttctttcctcacaagggacttttttgttccattatgccttgttatgcaatgggctctacagcaccctttcccacaggtcagaaatatttccccaagacacagggaaatcggtcctagcctggggcctggggatagcttggagtcctggcccatgaacttgatccctgcccaggtgttttccgaggggcacttgaggcccagtcttttctcaaggcaggtgtaagacacctcagagggagaactgtactgctgcctctttcccacctgcctcatctcaatccttgagcggcaagtttgaagttcttctggaaccatgcaaatctgtcctcctcatgcaattccaaggagcttgctggctctgcagccacccttgggccccttccagcctgccatgaatcagatatctttcccagaatctgggcgtttctgaagttttggggagagctgttgggactcatccagtgctccagaaggtggacttgcttctggtgggttttaaaggagcctccaggagatatgcttagccaaccatgatggattttaccccagctggactcggcagctccaagtggaatccacgtgcagcttctagtctgggaaagtcacccaacctagcagttgtcatgtgggtaacctcaggcacctctaagcctgtcctggaagaaggaccagcagcccctccagaactctgcccaggacagcaggtgcctgctggctctgggtttggaagttggggtgggtagggggtggtaagtactatatatggctctggaaaaccagctgctacttccaaatctattgtccataatggtttctttctgaggttgcttcttggcctcagaggaccccaggggatgtttggaaatagcctctctacccttctggagcatggtttacaaaagccagctgacttctggaattgtctatggaggacagtttgggtgtaggttactgatgtctcaactgaatagcttgtgttttataagctgctgttggctattatgctgggggagtcttttttttttatattgtatttttgtatgccttttgcaaagtggtgttaactgtttttgtacaaggaaaaaaactcttggggcaatttcctgttgcaagggtctgatttattttgaaaggcaagttcacctgaaattttgtatttagttgtgattactgattgcctgattttaaaatgttgccttctgggacatcttctaataaaagatttctcaaacatg

SEQ ID NO: 13197 - DNA, 1688 bp, Homo sapiens
  ENST00000372816
gtgtgtgctggctgccgggctgccccgagccggcggggagccggtccgctccaggtggcgggcggctggagcgaggtgaggctgcgggtggccagggcacgggcgcgggtcccgcggtgcgggctggctgcaggctgccttctgggcacggcgcgcccccgcccggccccgccgggccctgggagctgcgctccgggcggcgctggcaaagtttgctttgaactcgctgcccacagtcgggtccgcgcgctgcgattggcttcccctaccactctgacccggggcccggcttcccgggacgcgaggactgggcgcaggctgcaagctggtggggttggggaggaacgagagcccggcagccgactgtgccgagggacccggggacacctccttcgcccggccggcacccggtcagcacgtccccccttccctcccgcagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcggagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcactggctactaactgaccaaaaagcctgacagttctgtcttacgaagacacaagtttattttttaacctccctctcccctttagtaatttgcacattttggttatggtgggacagtctggacagtagatcccagaatgcattgcagccggtgcacac

SEQ ID NO: 13198 - DNA, 1944 bp, Homo sapiens
  ENST00000372815
gtgagtgcgggccgcgctctcggcggcgcgcatgtgcgtgtgtgctggctgccgggctgccccgagccggcggggagccggtccgctccaggtggcgggcggctggagcgagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcgggtaaggacctccccgagccatccaagagggggccaccccatgggtggccaaagctctgcccctgcctgaggtcaggcattggctcttctcaagctcttgggccatctccgcctctctttggctgaagctgcccgtgtagtccccaaccgtgtctgtctggcacgtgggtgtgttggtaaacagtttggaaaagtggcgtgggagccagcctccctttgatgattattggagccccaggggacaagggatttgaggtgagggttggcgcttagagaggacaatactggggttggactgtaagggattgaagggggtaccttaagagacactccaaacctgaagtttttttgctgctgcctctttccctaggaaactcacactcccctagggggagaagaagccgagagccttttgtgcaaagccaaaaccttcgtccttttaaaaacctaggtctccagttggctttactttaaaatgccaataataaatgccctcttctcgtgcctccccaccaccacttaccactcgtgcatccctgagacagggagggaagaatgaacactccccattaacagatggaaaaactgaggcttagagatagacaatcactacaagtcagctccagctttctgccatctagccagcccctcttccccaatgctccatcccaaccaggcacctcttccttgatgtttggggtctttgtggtagcttatcttagaagcactacaccttgccttgctgtttgtcctgagatggaaaagtgtccttcttgctccccctcaatagatctccagcgtcagctgctccctggcattcaacaaatattcactggcccctactttgtggcaatctgtgggctacatgctggggtcaaggcagtagaactccaggccctcctctcccatccttgatgcaagtgcaacctcgctgagggcagactggggcatcctgtgccactaaactacattgttcttattctggcatcttagacctccacacccgtgagaaatcctggagagggtatttttgtagagtgtagactgtggctagtgacaaataaattaggaccaagaaagctcactgtagcttttaggaataacttttacacgaccatttgatagggaactggggaatggggtatggaagttttcctacacttgagagaaaaaataggataacaaaaattaaaagtcttttttttcctggtccactgtgttaaggtcatttttaaccagcttgctttctacaccaagagtttatgtttgtttaatggctggaaagagaatcttgagatcaaaaaaccaataaagatgtatctctacaa

SEQ ID NO: 13199 - DNA, 426 bp, Homo sapiens
  ENST00000450953
gcaccgccaagcggccgccgggccgcatcagccctcctcctgtttgcgctccccagcgtgcaatttatttggggggctaccggggattgaacggagcgggcgagcgctgccaggagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcgg

SEQ ID NO: 13200 - DNA, 6886 bp, Homo sapiens
  ENST00000612165
gcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgctt

SEQ ID NO: 13201 - DNA, 6847 bp, Homo sapiens
  ENST00000621545
gcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgctt

SEQ ID NO: 13202 - DNA, 541 bp, Homo sapiens
  ENST00000632764
agttagcggatggcatgcccggaagccatctgaaatcacctctagagtttggggaccactgcgtgagacagggaaaagtccaaacccctctgagaaggggaagagagcagctggcgcagggcaccaagccttcagggaaaagccccactcgctgcatggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggt

SEQ ID NO: 13203 - DNA, 6272 bp, Homo sapiens
  ENST00000616422
gcagggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgta

SEQ ID NO: 13204 - DNA, 6029 bp, Homo sapiens
  ENST00000634050
gcagggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataa

SEQ ID NO: 13205 - DNA, 5725 bp, Homo sapiens
  ENST00000631693
gagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtaagtggctctgggtggtttttctcgtccatgtttcgcctgcccaccctctgtgctattcaccagtccatgcgaggctagctcctggcctttttcatagcgaactatcatcggaaatggaaggaggtttttggactggtgcaggggctgggaggggctgagaatggcagtcgaggatgggtctgagttggggggtccgaggataaggctggggtctgaactctcaggggtcatcttgagtcccggccatgcatcctgtgggaggccaaagccacctccctgatctcctgaggtgccgctcacggtgggtttctcaatcgtcttcatgaagttgagcctcatagaatggggctgcccgctctgccggcaggtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggtaggaaactgaatggaggaagagggctctgaagcagaggatggggggacaggcagcatcctcgacccccattttattttttaaattttttcgagacagagtttcattctgtcacccaggctggagggcagtggcacaatcttggctcactgcaacctccacctcccaggttcaagcaattctcctgcctcagccttctgagtagctgagactacaggtgtgtaccaccatgcctggctaatttttatatttttagtagaggtggggtttcaccatgttggccaggctagtcttgaactcctgaccttaggtgatcctcctaccttggcctcccaaagtgctgtgattacaggtgtgagccaccgtgcctggccctggacccccatttcaatgctgctgctgacgaagcgtcctctgagattggggacagacccatggtggttaggttttccgtcagcgctttcatgcctgtttgggggtgtggctgctttcattcattcccaataagtagctgtgtggggagaaggggaggccaggaagagtcagggaggagtgtgctggtccccatcccaatcccagctttgctgacacggacccggcctgagtcccggctgtccacttcctggctgtgtaactacagatgagtcttctaatcttctccaagcctcagtttcacccattagatgatgagggcaatacccctgaggcatgactccaaggagggggcatcttttaaggcgggggagggtagaggcccccaccatggccgcccttcccccaggaacgcactccaggacgagaagcgccgcctggaggcccggatcgcccagctggaggaggagctggaggaggagcagggcaacatggaggccatgagcgaccgggtccgcaaagccacacagcaggtgagggccgcctggacaccacagtcacgctgcctactgtctctcctgcagcaggatcctgcaccagtcaacacacgcgtggcggcttcctgtgtgcaggccctggattgagggacaagagggtggtggggcctgagagtagagatccagggcccttacaccagtgcccaggctgctgtcttcagaatactcctctccacgctgcagtgtctcattttccagccacggcgtggctggctccccgtacctcacggccatccctggagtccgggccttgggatgctctttcattgcgttttcccctagctgaagctctgaccttatccagtgagcccttggtgatgtcactgagcactagttccatggtgggcactagggaccatccagtaacctgcagccccttgtggtgtagggtgaacaggcatcattctccaggcgactccaggacagagaaagcaagggacaagtcactcgctcagcctgggtggcactgacacttgtggaagcacctcttttttttggagacagggtctctctgtggcccaggctggagtgcagtggcgcaatcttggctcactgcaacctctgcctcccaagttcaagggattctcctgcttcaacctcccaagtagctgggactacaggcacgtgccaccactgcccggctaatttttgtatttttaatagagacggggtttcaccatgttggccaggcaggtctcgaactcctgagctcaagtgatttacctgcctctgcttccaaaagtgctgggattacaggcgtgcgccaccacgcccggcctggaagaagctcttgagtggagttttacaggatgaaggagaggacagggtgcccgggatcaagggactcgtgcagaggccaaacaaggcaggaagaggcatggtctcagtgcgctctcttgggcttccctgagtccgcctcatggccttcactctcctccccaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggtgaggagcccgtggcccgggaggaccccgtctctcaggccagagaaaagcactgggggctcgggctcctttcggcctgcaaatgccccttgtgcccacagccgccactcccttctgtggtttattcctgcttctccttaatcactaagcttagtgtgggccaggcactgagatcagacccgggccctgccttgcctggtagcagctaaccttctagatcctttaacgatcgaccgtctcccatccggtcctccggctgaggaggaggaagaggctatccccactgtctcctccagcccctccttcattgcatcactgagtcttcacgacatccattgaagctgcaacaccaccccccgccacttcacctccttcctgacatgctctgctcctcctttctccccctcagcactgctgccatctgggctgcattattctcgggtatgggggctgtccgacattccccatcagaaggaaaaagatccctgaaaagtagcaggtgcttacatttctggcctctacccaccggctgcagtagtcccccaccaccctgcaatgtgacaaccaaaaatgtctctagatgttgccagaagtcctctagagatgggagggtacgactgccaccccgctgagaattcctgctgtcactggagtgggggctgttttctctcccatgcctctggtaccttgggggtcccccctgctcccaagggctgcttccaccaccctgtccatccatcccgattggctcccaggaggttttagctccgggcttcctgtctcccacaccactcctcacagttctccatgatttcaacatccaggtgggcgacgcagcctctcggttccttgaccctctgggtgatcctgctgcttctaccgggccaaccagtactcctaggagccctcacaatttgaccctcaggcatcccattgtctgcctggtgccacctttctttggctctgtccccaacggggtcttcactccattaatgccatcagcctctgacccagctccaaaccagctgtctagtaacccccgtcgcgcatcctcaacatccggttccccctcttgcattgctgcaatcatttggtgaaagcacaacccaaatgaaactcaagcttggctgggcacgggactcacacctataatcccagcactttgggaggccaaggcaggtgaatcgctttgagctcaggagttcaagagcagcaagaccccatctctacaacaaacaaacaaaaatcagccaggtgggatggcgcaaacctaaaatcccagctactcaggaggctgaggtgggacgatcagtggagccccagaggtcaaggctgcagtgagccatgatctagccaatgcacttaccctggatggacagagtgagaccctgtctcaaaaaacccaaaacccactctccaccttttcccacagagcaggccttgctcaggggtcctcccacacccctccctcatcttctcactctctgctgcttttcactttttctttgaacttatgatcgctcctccccattctctctcagctggggaccttacttcctacttaactcaaaagcagaaatgatcatgaaacgtgcacaagctcccactgcctcatcatcctacctccgtgcacctctgtacacttctattttttttccatttctatgctgaaccctctggcaccaaccgaggccaacacctccattggacccgaccctcttgttcactcaagcacatagctccaaaaatccttattttgcaaggttttctctttcatttgctccatcagcaaatggaataacctcttagccccatgtctaccttgctacccttactacaaaactggatgtgaatgccgaaaccctgtctctaccaaaaaatataaaaattagccaggtgtggtggtgcatgcctatagttccagctactcaggaggctgaggcacaagaatggcttaaaaccgggagagagaggttgcagtccagcctgggtgacagagtgagactcggtctcaaaaaa

SEQ ID NO: 13206 - DNA, 4087 bp, Homo sapiens
  ENST00000633845
ttttatcagagtcccatacctcacgggtattttctcaatcagtgaacacctcaagtactagcccatgtgttttgagtaaaaagggctcctttcaacgaggatccccttctagaggctttgactaaccagtctcttggcacccttagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggtgaggagcccgtggcccgggaggaccccgtctctcaggccagagaaaagcactgggggctcgggctcctttcggcctgcaaatgccccttgtgcccacagccgccactcccttctgtggtttattcctgcttctccttaatcactaagcttagtgtgggccaggcactgagatcagacccgggccctgccttgcctggtagcagctaaccttctagatcctttaacgatcgaccgtctcccatccggtcctccggctgaggaggaggaagaggctatccccactgtctcctccagcccctccttcattgcatcactgagtcttcacgacatccattgaagctgcaacaccaccccccgccacttcacctccttcctgacatgctctgctcctcctttctccccctcagcactgctgccatctgggctgcattattctcgggtatgggggctgtccgacattccccatcagaaggaaaaagatccctgaaaagtagcaggtgcttacatttctggcctctacccaccggctgcagtagtcccccaccaccctgcaatgtgacaaccaaaaatgtctctagatgttgccagaagtcctctagagatgggagggtacgactgccaccccgctgagaattcctgctgtcactggagtgggggctgttttctctcccatgcctctggtaccttgggggtcccccctgctcccaagggctgcttccaccaccctgtccatccatcccgattggctcccaggaggttttagctccgggcttcctgtctcccacaccactcctcacagttctccatgatttcaacatccaggtgggcgacgcagcctctcggttccttgaccctctgggtgatcctgctgcttctaccgggccaaccagtactcctaggagccctcacaatttgaccctcaggcatcccattgtctgcctggtgccacctttctttggctctgtccccaacggggtcttcactccattaatgccatcagcctctgacccagctccaaaccagctgtctagtaacccccgtcgcgcatcctcaacatccggttccccctcttgcattgctgcaatcatttggtgaaagcacaacccaaatgaaactcaagcttggctgggcacgggactcacacctataatcccagcactttgggaggccaaggcaggtgaatcgctttgagctcaggagttcaagagcagcaagaccccatctctacaacaaacaaacaaaaatcagccaggtgggatggcgcaaacctaaaatcccagctactcaggaggctgaggtgggacgatcagtggagccccagaggtcaaggctgcagtgagccatgatctagccaatgcacttaccctggatggacagagtgagaccctgtctcaaaaaacccaaaacccactctccaccttttcccacagagcaggccttgctcaggggtcctcccacacccctccctcatcttctcactctctgctgcttttcactttttctttgaacttatgatcgctcctccccattctctctcagctggggaccttacttcctacttaactcaaaagcagaaatgatcatgaaacgtgcacaagctcccactgcctcatcatcctacctccgtgcacctctgtacacttctattttttttccatttctatgctgaaccctctggcaccaaccgaggccaacacctccattggacccgaccctcttgttcactcaagcacatagctccaaaaatccttattttgcaaggttttctctttcatttgctccatcagcaaatggaataacctcttagccccatgtctaccttgctacccttactacaaaactggatgtgaatgccgaaaccctgtctctaccaaaaaatataaaaattagccaggtgtggtggtgcatgcctatagttccagctactcaggaggctgaggcacaagaatggcttaaaaccgggagagagaggttgcagtccagcctgggtgacagagtgagactcggtctc

SEQ ID NO: 13207 - DNA, 549 bp, Homo sapiens
  ENST00000632352
gtgctctgatttagagctcctcagtcttgccactgttgatattttggggtgactaattctgttgtgggggctgtcctgtgcactgtagggtgtttagcagtatccctggcctctacccactggatgccagaggcaccccccaccccagctgtgacaatcagcagtgtctccagacaatatcccctagtggggatcggtgggggcaacattgtccctggctcggaaccactgatcgaatttattatgacaacatatccctttgccacaaaaacaaatgatgggctaaccgtgtgtgtgcaggtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagata

SEQ ID NO: 13208 - DNA, 3450 bp, Homo sapiens
  ENST00000632632
ttctctgggagctacaaaaaggaggatgtgtggacaaatcaaaacagaaacaaatagcagcttcctgctttgtcctgtagaccaggtaccctgatgccttcctagcatgcggaggaatgaggaggaagccatgcccatccttgtcccctctagacactttcccggctcctgtccagcccagccctgatgcctggaaaaataaggaagggaaagcaggaggggaggacaaggagaaaaactcccagaatccagggcctggaggcctcggggcccaactgcagccgccatgttttagggctaggccaagagcagctcgtttgctttcccagcttaacttaccacattggccctttcctgccatgattaatcacgtgaccgcgtttgtgcaaaggcatcccggcagagggggccggtgggctgtgtacagtctcagcttcctttaacccaatgaatggagctcaggcaacctgctttgaagctttattccgcagtccgctaagaggattcctggtgggttttgtgcattccttacttgtctgctgtagaagacttcagaaaaccagtcctgagaaagaaaaaattgcaacttaaaaaaaattgcactaaaataattagaaggaggcttgtagtggtttaacttgaagaaggctgcttgttaaacatgaacagcagcacgactgccatgtacagtgggacaggtggtgcactgcacaactccggggggcaccattcatcatgatgtaaatgacatcaccgacattgtgcaaggcagtggctttgagtggcagtgatgttgcacagatgagcaggccctggtcttgaaaaaagtgaccttcctagggagcagatgtcctagctattagagagctcagacagttgcttctcttctgaaatcctcctgtaaatctgaacattagcatcagggtctaagaggaggtaggagataggagagaacctgtgggttaagggcagagttttgtgacaacatccatccaaggtagaactgtcaggacctaggttgctttctccaataactagatgtgaatgaattttagggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagagggtgaggcccgccgcccagaccctggggctcccagaagccagggctgtcccaagcggtcacagcgtccccagggcgccctctgcccccacctaccccgaggaccccattttccatgtggggaaggctatctgaatctcagacccattccccatccctggaggaaaaggaggaagggaggatgcatccagagacttttcagttgtggagttgctgtgcaggtcatccagccactcattcattcattatcccaggaagtattcactgggctctgccctgtcctgggtgctggggagcagtgttagaaaaattgtagcccttccctgtgggtttctcataatctggtgcaggcatcttcagcttggggcgattgtgtcctctatatggacatgctacagacatttttggttgtcacaaccaggagggggctgttagtcagcatctagtgggtaggggccagggatgccctaagcattgtacaatgcacaggatggtccctcaacccccagcacagaatccctacaagatgccagtagtgctgaggttatgggagacacggggagaggtaaacatacagctgatgatggtgatggaatgtggtcagttaggagaacaccaaagagccagggctcctcccacagcctcaggactcagagaaagcttctggtgaacttgaacgttaagaatgtgtggccatcaacttggtgacatggaaggcagggtggggcctaggataagcagggggcctaggataagcagagggcccaggctaagcaagagtgtggaggtgagaagtgaaggaactaggtaagaaaatgctagatagtgtccaggcgtgttgctcacgcctgtaatcccagctactcaggaggctgagaaacaaaaatctgttgaacccaggaggcggaggttgcagtgagctgagattgcaccacagcattccagcctgggcagcagagcgagactccatctt

SEQ ID NO: 13209 - DNA, 979 bp, Homo sapiens
  ENST00000631759
actcctgtaatcccagcactttgggaggctgaggtgggaggattgcttgagtgcagcagtctgaggccaacctggacaacacagtgagatcctatctctacaaaaaaaaatttaaaaattagccagatatggtggtgcatgcctgtagtcctagctgcttgggagggtgaggtcatggggaaaaggggattgcttgagcccaggagttcaaggttacagtgagctgtgattgcaccactgcactccagccctcgctgacagagcaaaaccttgtctctaataaataaataagtttttttaaatagggatagccatgatggactacggtcattgcaaaagccgaatgaaattgatctgtgaacatgttttacacgttctgttgctgtcaggcctggggtggtttcagctcagcagatgttggttccgcctgacaacttgacctgtggggttctgagtgttcgcaagaatctccccgccccacctcccatcctctgtaccatctgcctcctgcttgcccacagcatggggttaacggctgaagttgggcagcaaagcctgaactgtgttttcctgttggcagggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtaagtgactagcaatgacatgtgattggatggcttgagccttccctttcatcagaatccggggttaagggattggctattaaaacagtctcagatcctgccagaaaggaccatgtctgtgagtgacatatgaacagttcttcatctcctcccaatgagtgagtgtggcttgtgttcagtcattctcatttactgagcacctactatgtgacatagtagccatcaactccaattag

SEQ ID NO: 13210 - DNA, 2353 bp, Homo sapiens
  ENST00000633799
gagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacggtgagtggcagttcccaatcagaggccatgatttagccaaccggtctccagcttgcagcccaaccgagatacaaacagaacatcattgcaagaactcaggccccatctgactacccctcccctgaagactcaaagagggaccgtctttttggcgagcaggcctgttgagtgtgggtgatttcttggctcagctagaagcatccctccagaagggggcccgttttgtgaaatgagaataagccctttccttccatagcgagatcttcctccacgtcggggcttctcagtggtggcactgatgtcattttggaccagataactcttccttggaggggcttccctgtggctcgtagaatgtttcacaacatccctggcctcgacccgccagatgccgacagcccccttccctccagttgtgacaaccaaaaatatctctagacattgtcagatgttccctggggtgggacagttgcccttgattgagaagcactcctttcatgaatctctgtaacgtcccaggggttaaggtaccttttgggttcccggattcctccacgtgtccccctgtccctgggatggagatgctggtatcactcggcccgtgggcttcagtgcaatgccattcagtaactgtggattgagcacctactgtatgccaggaaccacttggggtggggacctggggataagtctgagagatgctgttattctcttctctgagcttccagacctgtggaagagcatgtagttgtcaaagaatccctcaaataaacagatgatgacacggtatgactaagagcttgggaggaaaagaagagcaggtttctagagtcatcacctctagggcccatccttctcttcctcctcgtgtgtcagccctgccccatctatcccacaggagggggcacgtggtagggccgctaggactggccggtgcctccgtctgcaggtttgtgggtgggaagatggtaggatggagatctgaccacggcatggggtgtctccagtgttcgccattccagatgtcactttgcgtcctcagaggggactctggggcagccaccatggccggcttgtctggaggcccttggagatctaggatgggcgctggtcgtggctttggagaactttccttctccaaacaaatgcaggaaactcaagattcagcatcctagaattgtctctggcaagttggtttccagccatagtgagtgggaacaatggccccagaggctgtgtggcagtttaaacacagtttccactgccttccctttccctaaagagtaaacacaggagataatactttctaacaactcatcgttatcaagggcctactatgtgctgcttgttttggctgcatgcgtaaacacatctcagacattgtctcactggatactgttttaaggagcctaatgtggccccagtaattatgaaaacctttgaaatgtctggatctctaagaaattagaaaaaggagggaatggctgagcatgggggctcatgcctgtaatctgtgttttgggaggccaaggtgggaggatggtctgagcccaggagttcaggaccagcctgggtgacatagtgagaccctgtctgtaccaaaaaaaaaaaaaaa

SEQ ID NO: 13211 - DNA, 6847 bp, Homo sapiens; identical to SEQ ID NO: 13201
  ENST00000396324

SEQ ID NO: 13212 - DNA, 6886 bp, Homo sapiens; identical to SEQ ID NO: 13200
  ENST00000452625

SEQ ID NO: 13213 - DNA, 541 bp, Homo sapiens; identical to SEQ ID NO: 13202
  ENST00000573908

SEQ ID NO: 13214 - DNA, 6272 bp, Homo sapiens; identical to SEQ ID NO: 13203
  ENST00000576790

SEQ ID NO: 13215 - DNA, 6029 bp, Homo sapiens; identical to SEQ ID NO: 13204
  ENST00000300036

SEQ ID NO: 13216 - DNA, 5725 bp, Homo sapiens; identical to SEQ ID NO: 13205
  ENST00000576164

SEQ ID NO: 13217 - DNA, 4087 bp, Homo sapiens; identical to SEQ ID NO: 13206
  ENST00000571275

SEQ ID NO: 13218 - DNA, 549 bp, Homo sapiens; identical to SEQ ID NO: 13207
  ENST00000574119

SEQ ID NO: 13219 - DNA, 3450 bp, Homo sapiens; identical to SEQ ID NO: 13208
  ENST00000570785

SEQ ID NO: 13220 - DNA, 979 bp, Homo sapiens; identical to SEQ ID NO: 13209
  ENST00000571910

SEQ ID NO: 13221 - DNA, 2353 bp, Homo sapiens; identical to SEQ ID NO: 13210
  ENST00000571505

SEQ ID NO: 13222 - DNA, 6137 bp, Homo sapiens
  ENST00000598205
gacagatgtccctgaaggcccgagggacaccagccgctatgccaggctccaaagaacccgaggcaaaccaacgctggtcccggtctttgaggactccccggcccagtgagggagaccgacagaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtga

SEQ ID NO: 13223 - DNA, 3046 bp, Homo sapiens
  ENST00000599920
cccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggc

SEQ ID NO: 13224 - DNA, 6896 bp, Homo sapiens
  ENST00000601313
gaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgaacatgggggcttccagcagttctctttccttggctccttcccaccgtcgcccccaggatctgcagagaggtgcagctctgctatttctccgccaggggtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggaccatc

SEQ ID NO: 13225 - DNA, 5988 bp, Homo sapiens
  ENST00000596571
atggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtga

SEQ ID NO: 13226 - DNA, 4039 bp, Homo sapiens
  ENST00000595016
ttttacatatgatgctatcatggctccatgttaatttttgtgaatataaatatccaagtattccaacactgctctccactgacttgtttttgcatatctattgaaagtcatttttcttcttcttcttctcctccttctttttcttcttcttcttctttttttttttttttttgcccaggctggagtgcagtggcgtgatcttggcttgctgcaacttctgcttcccgggttcaagcaattctcccacctcagcctcccgagtggcttggattacaggtgtgcgccaccacacctggctaatttttgtatttttagtagagatggggtttcaccatgttggccaggtggtcttgaactcctgacttcaggcgatctgcctgcctcagcctcccaatatgctggaattacaagcataagccactgcaccagccttttcttcttatttgaagttattttgcctcttctagttcctttgcatttccgtatgtattttagaatcagtttgtcaatttctaccccaaaacaaaaagccttccaatttggaactgtgttgaatctatacaacggttttggaagaactgacatcataacaatattgagttttctcaccgaggaagagggtatatacgtccattgaaataccttagaaatgttttttagttttcaatgtacatctttcacatctgctgccagatgtatttctaagtatttcatggttttatggctattttaagtgatgttgctttcatttccatttttgattgctagtatatagaaacaatagatttttgtatattgatcttgtatcctacaatcttggctaaactcacttactagtgctaatatagtttttatatatttcattggattttctacatagatgatcatgttttctgtgaacaaaggcagttttacttctttctttaccttttctttacccttctaggactccaaatgcttgtatgtatgactgcttggtacttttttcaggttgttaaagttccattaatttctgttacaatcttctttctttttctttctttgctctgtttggataatttatattgacctgctttcaagtttactgattctcctgatgtgtccagtctgctactaatttcatccagtgacttttttatttcagatatttcatttttcagttctggcatttctatgtggttctattttacagtttcaaatccctcctcaaataactgcctcttcacccattgtatctgtctcgttctgaaacttatcatgaagtccttgtgtgcacgttctaatatgtaggtcatctgtgggtctatttgtatggactgatttttctcttaactatgagttctgttctcttttcttttttgcatgttttataagtttatttgccaattactgtgtcttaaaaaaaaacagtaaaggttgaagtacatttaaaaatatatatatgtgtattttttctactgccactcttaagaggaaggaatgccctttcttctgttgaacatatagagttagggactgatcagtttgatccattcaagagttaagctggtttgggacacggttgcaactttaatccctctacctccctcttgtgtctctgcctttgtctgtctctttctctctctttctctgttcctggctgctccctcttcccgttcccttgtacactcctttcagctaatctatttccccctaccccatctccctcaaactggaagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgg

SEQ ID NO: 13227 - DNA, 2225 bp, Homo sapiens
  ENST00000597072
agagtttaacttcttccctcactttggctgcctcagctccctacaagggcccttcctagatgccagaatttataaattgcgaagtcattgattccaaccctctgctgatgtgccaagtgccaggatggtatctgcactcacttccagtccagcacctgcacgttgcttcttgtgatgggagctcattgactccagaaaatgtgggataggaaggctgaacgataagaaatgaggtcagatcatgtatgttccctccctgaagagagaggtggtagggtctggggaggatctcagtgaagttggtctggacagtgggtttatgggaagagagaactggacaagaaaaagaccctgtggggcctggaatgccaggctgaggggctggaaccttgtcccgggggtactggggagccatgaaaggattgtgagcaggagggtctgggtcagctctgggtataggaagacctttctgaggccatgtaggagacaacctggaggggagagactggaggtcagggtagaggctggcatgagggatttaggagaaaagaacaaggcctaaacagagagcagaggatggggcagagagagtcagggggcagtagggatggggcagtagtgggctgttggagagggagggagtgatgacagtacctggagatataacccagtccccctgcttccatcaagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcggtatggtcatcccacgtacaggcctgacgggtggggagcaccctaactccataaaccccagggacgcgaggccgtgccaggggcaacaacagggggaaatgggatccacgggggtgtggggctgtgggagcagcggctgtgttgcgggagagccaaatccaggtaacttctttcttcccacacccatttctccctgtcatctctgtgccctcctttcccaccgtgcaccaccacctttctctcctttcctcctctctgtgtgtccttcatctctctctgccccccattgcttctgcccgtctccctccatttctcttgatctcatccctctcttcccccttattttgttctctctcttcctatctctctctctctccccctcatctctctctctcctccccctttctcctcccctcccctcccctcatttcatctctgtatcctggtctctcctccccacagacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgg

SEQ ID NO: 13228 - DNA, 6811 bp, Homo sapiens
  ENST00000425460
ctctttctccccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggacc

SEQ ID NO: 13229 - DNA, 6787 bp, Homo sapiens
  ENST00000376970
ctctttctccccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggacc

SEQ ID NO: 13230 - DNA, 3848 bp, Homo sapiens
  ENST00000262269
gaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgg

SEQ ID NO: 13231 - DNA, 4247 bp, Homo sapiens
  ENST00000440075
ctctttctccccaggccgaagcctcgggacggccctggaagccgaccatggcagccgtgaccatgtcggtgcccgggcggaaggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatgg

SEQ ID NO: 13232 - DNA, 5871 bp, Homo sapiens
  ENST00000356287
cgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaggtggtggccgcctaccggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggtgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggctgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcact

SEQ ID NO: 13233 - DNA, 2179 bp, Homo sapiens
  ENST00000557461
cggtccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaggtggtggccgcctaccggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaaggtgcctccttggcctcaccacctatgccccctcctctgccatccagacaaagtggtggctgagtcccttctacacccaagaaactagagtcccaagaatcccaggcctttctccaggcccagcttctccccactgtgaagtcatgggcatgaacaggatgatccccccactcttcctttcccaggaccttgcactttatgcccctttgtggtggtcccctcagtgtcttaagagtgagatgtagtgaaggagaggcccctggcccctctgaccgcccatgagaagcgtcattcatggaaagatcctaggctgaaattagagatgtttggcctcccaccaccttcctgttggttgagaaataagccagtctccagccctcttgcttatgggcattcctcagaagagacaaggccgcaggcgggaggccccataggctggggctgacttgctctcagtgaacctctgctctttgtcagcataggccagagcccggattgtctgacccacacccagcccagccacggccttcatgaaatgggagctt

SEQ ID NO: 13234 - DNA, 5941 bp, Homo sapiens
  ENST00000405093
agatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaggtggtggccgcctaccggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggtgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggctgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgcc

SEQ ID NO: 13235 - DNA, 1666 bp, Homo sapiens
  ENST00000356840
gggcagctggcgggcagcgggtgagggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcagtttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaaacaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaa

SEQ ID NO: 13236 - DNA, 2796 bp, Homo sapiens
  ENST00000349606
gcggccgcggggccccggacaagggtccgcagagctgcagccttcgagggccagccctctccgagtccggggctgggtcccaccagtgacaaggcggcagccccgcgcacaccaaagagaaggcggctgtggcggcagcggcagccccagccatgctgtgttatgtgacgaggccggacgcggtgctgatggaggtggaggtggaggcgaaagccaacggcgaggactgcctcaaccaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaaacaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagattgtggagaaagtaattattccaacacccatctgccatgcgatgttaaaaaaaaaaaaaaggaagaaaaataacacagctactcctcactgcaaaaacatatccatgcgtagaatcaacaactccagtcatgggaccaggaggagctctgggacgcagacacattccttggatgttgattttttttatgatctagtaaaggaataggtaaagtctttgatgtcagtgaagtggcaacatagccaaaaagttgggtaccttttaggaaatgatgttgtaagtctccttaatgtatcctgaggtaagtttcctactggcagcagattttgtaagaattacttttaagaatttcattctttttgtatggtcatggagctccaaccatttttaataggaaagtcttttgtaaattgttgtcgttttaatgtcatttctgtctttataacttgatcaagaatgattggaaggcaaacaggtttacaaatcaattctgtgacttttaaaaagttgacaatgttgtcagatttaaaccagtgtggctagtaaaaagcagctcactcaatgtgggtggctccctattcctttacgctccccctatccctaccccacaagcctttcgattataaaatactaccaatcttgttataagattactgtggagtagtcaagtactccccgggccttctgagctggtggaatattttatttcagactgaaaacagagagcactctccttgggaagggaaagcggagcttgctgagtgagagatggagcctcatggtgtacaactgagggtagttaactcatcacttctcccaagcactcgatcccagcttcacccactggtgttgctttgcttgaactgttcaagccttttatagccttaccataagtatttagatatggtgtccttttctgtttttggggggggagttttgttgtgtttttttaaagtaagtgcttaagtattaactttgggttgtcccctctgtatgtttcgaaggggttttggttctttttgcttctgttttcttaaacatgttttccactcccacttgggcattttggaagctggtcagctagcaggttttctgggatgtcgggagacctagatgaccttatcgggtgcaatactagctaaggtaaagctagaaacctacactgtcactttactgagatttctgagtatacttttcatattgccttaatgtagcagtaatgtgtttatgcatttgtttctttgcacagacattttgtcaaatattaaaactctacttttttatggcacatattagcatataagcctttattccaagaggtatttattttttcacttgtaaaaaaataatgtttccacgtaaagaactctgttatatcctagaggactctgtcttttatattcgggataataaagactttaaagcaaa

SEQ ID NO: 13237 - DNA, 8038 bp, Homo sapiens
  ENST00000513610
gccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaacacgctgtgtgtttcc

SEQ ID NO: 13238 - DNA, 4839 bp, Homo sapiens
  ENST00000515803
ttctttctaatgccaggcaatcaaggctgcacttgctacccttctgcaggaagcttcccagccagcacagtttctctctgccctgcctcttaatccccacccctgctcccaggcctgggacactgctaaccacccctccttcctgacacctctctgaccacccctcctcctcttgactggttcctctggaggtaggcatggcctcgggttctgcccccagtttctcactcgctgggctccaaaagaaacactggcttctctccttcagctccaggctagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaacc

SEQ ID NO: 13239 - DNA, 4803 bp, Homo sapiens
  ENST00000505695
agcaaagagtgctgttcttgttctctgggtggattttccaagatcacaactaaactgcttgattttgtcctgggactttttttaaaaaaaaattattgattggcttttaaaatcaagaatctttgggccctgaaatgtaattacacatttgttgatgcgtgcatgatggttagtttgcccctgcagtcaaaagtgtcttcagcagttcctatcacgtcagcctcgccaggctggacttcctttgagtagaatcaggaatgaattaagcagcacagcccgagacgcaccacataaaaggctgggaacaccagccagccgaagaaagcccatttttgtgtctgtcagcttagatgcccttgcccggactgctaaagatgcagctatttacagtggacagaaactgaaggggtgaaagaaaacccaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctga

SEQ ID NO: 13240 - DNA, 2910 bp, Homo sapiens
  ENST00000513882
aatctgtgatttaggagtgagttctttccatgcttctcctctcctcttttcccttcctagcaagaggagaaaaaaagcaagtaatttaatgtaatctgatttttttttttttttttttttttacttcatggctttttgacattggaagagaaatgagccatctttctagaggagctttagtgtcatgtgtgcttttcttattgattgggaataacttaaaaagactcctcagaactccgaatgggatatttaatttgttagaacacgagtctgcaccactatctgttgacggtgaaatgaatttactaagtggataatttgctgagcattagctgaccctgacgtggcggaacgaaggtctctggagatggttcatggtggaaatctgggcttgatgggtcggtaatgagacttcagcgatgacatctttaccaaggctgaggcttaacactcgggaccaagcgattcaactgggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaag

SEQ ID NO: 13241 - DNA, 575 bp, Homo sapiens
  ENST00000506343
aagaaagcccatttttgtgtctgtcagcttagatgcccttgcccggactgctaaagatgcagctatttacagtggacagaaactgaaggggtgaaagaaaacccaagatgccagaccagtttgaccaggcggttgtgctgaaccagctgcggtactcagggatgctggagactgtgagaatccgcaaagctgggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctg

SEQ ID NO: 13242 - DNA, 807 bp, Homo sapiens
  ENST00000512061
agatgcccttgcccggactgctaaagatgcagctatttacagtggacagaaactgaaggggtgaaagaaaacccaaggcaatcaaggctgcacttgctacccttctgcaggaagcttcccagccagcacagtttctctctgccctgcctcttaatccccacccctgctcccaggcctgggacactgctaaccacccctccttcctgacacctctctgaccacccctcctcctcttgactggttcctctggaggtaggcatggcctcgggttctgcccccagtttctcactcgctgggctccaaaagaaacactggcttctctccttcagctccaggctagatgccagaccagtttgaccaggcggttgtgctgaaccagctgcggtactcagggatgctggagactgtgagaatccgcaaagctgggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgct

SEQ ID NO: 13243 - DNA, 537 bp, Homo sapiens
  ENST00000510401
atttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacg

SEQ ID NO: 13244 - DNA, 582 bp, Homo sapiens
  ENST00000508318
agaaagcccatttttgtgtctgtcagcttagatgcccttgcccggactgctaaagatgcagctatttacagtggacagaaactgaaggggtgaaagaaaacccaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtacgatgcggagaaagagcaactcccaccgaatccctgacagatctcggggtgatgctcacagggtttagggctctatgacaccgctatacaattgttctttcacattgggaagatactcctgttgccatgcctaccataaccttttgtctcccaaacagttactattttatttgaagtgaagtccttgacttgtcagggactctgtttcattagagaacacattgaaacatctc

SEQ ID NO: 13245 - DNA, 583 bp, Homo sapiens
  ENST00000511972
aaagcacaggaatggtgttcattattgttccatgtctttagctgtggggaaaaggtcagtgtggcagttgttttccatatgaattttggcccaagagccaaactgaaggtgagatgccccttggagagacaggaagatgatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtacgatgcggagaaagagcaactcccaccgaatccctgacagatctcggggtgatgctcacagggtttagggctctatgacaccgctatacaattgttctttcacattgggaagatactcctgttgccatgcctaccataaccttttgtctcccaaacagttactattttatttgaagtgaagtccttgacttgtcagggact

SEQ ID NO: 13246 - DNA, 766 bp, Homo sapiens
  ENST00000502436
gcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttatta

SEQ ID NO: 13247 - DNA, 1677 bp, Homo sapiens
  ENST00000507288
cggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatgtgcagataggttgaatatacctaatccaaaaactccaaatccacaatgcttcaaaatccaagacattttgcatgctgatgtgttgctgaaaggaaatgctcattgggaatattttggattttgaatttaacttaaattatgcttaaccagtacatagtatgcaaatattccaaaatccaaaaaatattgaaatccacaacactttgtgtcccaggcatttcacacaagggatgctcaatctatattttgaaactcatactttgctgtcattagagaaaaaacacaagtttgtttttttttgtaatagtgtcttgctatgttgcccaggctagactcaaactcctgagctaaagtgatcctcctgccttagcctcctgagtacctgggattacaggcacgtgccagcatgcccacctagacacaagttgttattgtacattttcaatagtcaagaaaaagtaagtaaattagaaggaaaaaaaaactacacaagggtttaaaaggcagacccttttaaaaagttttttatttattttcctcttttcatgataataatgttaaacctgacagctaaattgccaatacatactatgaataagatcttggtcttggaataaggtcatattcttcctttctaaggggaaacccgtaggatttttgtgcatccaatttgcagttcagttcagttaattatgccattgtagaccttccgtttgaggcttgcaaaattgtatattatccataaagcagccaccatgattttttaaaattatcattgaagccattcaccggagatgtcagcgtctgttggactccgctcacatcgagacaagaccgccacctgtcagaacagccactgcttctccacatttgatcctggctcggagcaatgcctgtctatatctttaaaagagaaaaaaaataaaatgacttgaattgttccaga

SEQ ID NO: 13248 - DNA, 11456 bp, Homo sapiens
  ENST00000274203
gagagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggcaagagggagctgaattggattctctttcttttcaaagggtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaacacgctgtgtgtttcctttatcagaggaggctctaaaaaccatggaggggaggcttatttttgttttggctttttggtggttttttttttttttctttagagacagagtctcactctgttacccaggctggagtacagtggcgtgatctcggctcactgcagcctctgcctcctgggttctagcgattctcctgcctcagcctcccaaggagttgggagtacaggcatgcatcaccacgcctggctaggttttgtatttttagtagagatggggtttcaccatgttggccaggctggtctcgatccacctgcctcagcctcccaaagtgctgggattacaggtgtgagctaccgcacccggccggctttttggtgttaatgctatggtttcagtgtctgggctttgtgtttgtttcatggacttgctcatcaggtctaaacacagatctgcagctgtctccactgctcttgtagacactgagtgtgacttcaagaaagcaaaagaagggactggtaaatgaagtcacacacagctgaggacttgaaatgtgtttatgtcagacagtcccctatgtcagccccaaagtgtgcctgatcttgcaaccctggatcctagaacctgcctgcacctccctgtggaccagaacacacaggtaggcagtttggttgccaatgtacccaaaccaccaggccaggcgtctagcatgagcaagcgccacttctcttgcagaccactgactcccaccctctgctcatgctcacggatggcttcttcccattctgcagggattgggatggaacctgaagccaggtgctgcctgaagcctgtggccccgccaggcacccaaggaaagccggcaaagacttggatgtgtgttgtctttgtttttattttaggctcagaaagaatttgacagaagtcttctttctactgctcacctctcaggattccctctgtgacttaatttactctggaaggctgtcgcccgccctcaattatagatggggaaataggcaaggaaaggcatgactcagattgggggggttagagcagcaccatagttagaacatagatttacatgtgagcctttacatggcatagttgtggttttgttttagccttttatttagaaataattacagactcagagaaagttgcaacagaacgtacagggaggcctgcgtgcccttcagtttccccagtggtagcatcccccatcactgtagagcagcatcacagctgacaaagtaccgttgagcttcccctagccacagaacctattccaattttactgcttttacatgcactcattggtgtgtgtgatgtcagttgctttcaacaaggtcagtgaagtgcagtcgtcccttggtatccaagggagattggttccaggaccccctccccccacccctgaggatacaaaattcacagatgctcaagtccctgctatacagtggtataatatttgcatagaacctgcacacatctttccttaccctttaaatcatctccaggttacagatacctagcacaacataaatgctgcataaatagctgttataccgtgtgtgtctgtgttttaaacattgtttatttgagacagggtctcactctgtcaccaggctacagtgcagaggcacagtcacagctcattgcagcctcaacctcctgggctcaagcagtcctccacctcagcctcccaaagtgctaggatgacaggtgtgagccactgtgccccaccaaaaaaagttttttcaaatattttctatctgtggttggattcagaccacatgaacactgagggctgactgtagttttgaatgtctgttactgaggaggcaccagcataaagtattttatcacttcagacgctgacaatctagtatttttaatttttaaatcttttgaaagctaatacatataggtgatttgtaaaaaaaaaaaaaaaaaaaaaaaaaaaaaaaaaaaaaaacaactagaagtaaaatgttacttttttccagctgtagccctaattacccattttcctttcccagaaacagctatttttactgttttattgaatattctctcaaaaataatttaagctgtccaatcatttactcatacatacatatatatccccatcctcatttttaatagatggaaacaaactgttgtagcttacttttttctcagcatagtattttagctctaatcctacattaatacctatagaattgccttattctttttgatgattatatagtacctcagatagctctgtggaaaaacaggataaggccatctgtattagtccattctcacactgctagaaggacatgcctgagactgggtaatttataaagaaaaagaagttgaatggactcagtctcacatgcctggggaggcctcacaatcatggtggacagcaaaggaggagaaaaggcacatcttatatggcagcaggcaagagagcttgcacaggggaactcccttttataaaaccattagctcttccgagacatactcactatggacaagaacagcatgggaaaacccacccccatgattcaattacctcccatcaggtccctcccgtgacaggtggggattatgggagctataattcaagatgagatttgggtggggacagagccaaaccatatcaccacctaagttctctgtaaaaatagtttcagccaggcatgctggctcacgcctgtaatcccagcatgttggaaggccgaggcaagaggatcgcttgagctccggagttcaagaccagtctgggcaacatgacaagaccctgtctccacagaaaattaacattagccaggtgtggtggtgcgcatctgtagtcccagctactggggaggctgagatgagaaaatcgtttgaacccaggaggtcaaagctgcagggagccatgatggtgccactgcattctggtgtgggtgacagagcaagactctgtctccaaaaaaaaaaaaaaaaaaaaaaaatagttcagaaatctaagacagcactttttttagttactaagccttttattcagatagcacactaaattggggtcaaaaatctgctatagtaaagttctgtatttgtgtgtattgggtataaaaataagcgctttaattaatttgaaaatccctattcaccaaaagtttatactgtaataggggacaaaacaagtgcataaagctaaatttagccagtacatttataactgtttcattcagttgatcagagaagcatcacgattgctggaaaatatcggacctggattcaaggtttggcattgctgttttcaaagtatgtaatcttttagatcaggggtcagtgaactacagtacagagaccaaatctaccctgccacctgtttttgtgaataaagttttattg

SEQ ID NO: 13249 - DNA, 3492 bp, Homo sapiens
  ENST00000251041
caggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaagaggaaggtgcttctgagcaaaaggacagaatttacaatgtacccttttgtatttatacaggaggtgtcagatttttttttttgtaaagggctagagaataaatattttagaccttgtgcaccataagatccttgttgcagttactcacctctgctgttataatgtgaaaaacagctgtagacaatacaaatggatgtgactgtattctgataaaattttatttacaaaaacaggcagtgggccatgtttggctcaggagccatgattgctcactcactctatcataaaagcaaaatatttgtggttgccatcatgttttatgaatctgtgaaatactttgatgcttgtacatatttattaaaagcaagtgtaattcataaataataatttttatttgcaggtactttgcttatagtatctaattcaattttcgtagcatcaaaaagctcccagttgaggaagatggtgaggtctgttgtagaatgtacacaagcagagctgagtctctgagaccactaaccaggtacagtcagggagcttggagacagctcatagagacacacagcaaatacactcattagtgcctaagattagaagtaaagtctacttcactcaaaaggaggcagaaaaaaaaaaaaaaaaaa

SEQ ID NO: 13250 - DNA, 6779 bp, Homo sapiens
  ENST00000357550
caggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaagctctggcccggcccagaccgcacagcgacgactacagcaccatgaagaagattcctcctcgaaagcccaagcgcagccccaacaccaagctcagcggctcctacgaggagatatcggggtcccggcccggggacgcgaggcccgcgggcgccccgggggcagcagcgcgcgttctgacccccgggactccgcagtgcgcgctgcccccggcggcgcctccgggtgacgaggacgacagcgagcctgtgtacatcgagatgctggggcacgcggccaggcccgatagcccggaccccggggagtccgtgtacgaggagatgaagtgttgcctgcccgacgacggcggcccgggcgcgggctccttcctgctccacggcgcatcgccgcccctgctccaccgcgcgccggaggacgaggcggcggggcccccaggggacgcgtgcgacatcccgccgcccttccccaacctgctgccgcaccggccgcccctgctggtgttccccccgacccccgtcacctgctcccccgcctccgacgagtcgcccctgacacccctggaggtgaagaagctgccagtcctggagaccaacctcaagtaccccgtgcagccggaggggtcgagcccgctgtccccgcagtactccaagagccagaagggcgacggcgacaggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggttcacccaaagccaaactctgcccccgtggccgggccctgcagctccttccccaagatcccatattcccccgtgaaggccaccagggcggacgccaggaaggccggctccagtgcctcgccccccgcgccctacagccctcccagctccaggcctctcagcagccccctggacgagctcgccagcctcttcaactcggggaggagtgtgcttcggaaatccgcggcgggaagaaaaatcagggaagcagaaggttttgaaactaacatgaacataagtagccgagatgaccctagtacgtcagaaattacttccgagactcaagacagaaatgcaaataaccatggaattcagttatctaattcactatctagtgctataactgctgaaaatggaaattccatctcaaatggtttacctgaagaagatggatactcacggttgtctataagtggcacagggacttcgacatttcaaagacacagggacagtcacaccactcaggtaatccatcagctgaggctctcagagaatgaaagtgtggccctgcaggaactcttggactggaggagaaagctctgtgaggaaggacaagactggcagcagatcctgcaccacgctgagcccagggtgcctcccccaccaccttgcaagaagcccagccttctgaagaagccggaaggggcctcctgcaacaggctgccgtctgagctctgggacaccaccatttgatgtggcctgaactgcagacttacaaaatagaactgcctactgattccgggctgcaacaacagaaggctgccttctgacatgcgctggggcttctctccacgcatttagacaaaaaaagcacaggacacagacactaaatatatgagatcccgtgtgtgtgtgtgtgtgtttgtgtgtgtgtgtgtgggttctttcttatccatctcgtggtgatacactctgattttcaagctcctcatttacggctctgtgctacccctaggtagcaagagagaggctgggaaaagtgtggacgtggccagagcgagagagtagcggaggaaaggagcaatccatgcacactctgtacagttgtttttctacggttcaacagtctgtttattgtacttccaatggttttattataatacagtatacgggacatatattttatttctttgtagctacttgtgttttattggtattataaacctgataattatttacatgtttattactgtaattttataaatttatgcaattggtggtgcttcctttcttcaaaatacagattttaaaaaatcatttctagattatttttttcctccacagtccttttttttcacctaacgcacctaaatcttgaaactacattgttgttttagcttcgccagtgtcaccccttgcaaaactatgaattgagccccatgttttaggtgttactcatggatgaggaggctgttctttcctatgccctgtatttctggataagtggattgtgtaccctttagttaaatttcacctcccgacttcagcatagatcacaggaaatcacatggcacacggttaaacacgtatggcttcaaatccatagccggtggtgtaaaatgatcatattcattcaaaggcctacacagtacaaatgagcacgctgccatgtactggtttgagcagtaggggctgcatcgcacagcgctcgtcccccgggacttacactgcatgattccctcactgtatatcctcaaccctcccataatgcaaggccttgttcattgatgtgctttcgtcggctgtcggaaagttctgagcagtggctccagaccaccttgtcttgctacttggaactttttattcataccagcctttgaaaagttactgtgccaataaagaggtacaactgtg

SEQ ID NO: 13251 - DNA, 617 bp, Homo sapiens
  ENST00000467639
agaagcttcagggaggtggctcaggcctaggctgcaagcagggaacaggtaccagcaaaatatgctaggaagcttctcgctgggaggctaatataaatgggtgggccatttgctaggatacaagagaaacttgccattgggctgctagggaaactcgcccagggacgtgcgcccctgggtctcccacacgccagtgacaaggagacctggggctctctggcaagaaccacaagaagccccttcttcctgctgtgtccctccagggccctctactgacagacccaacaccgttccagctggtaaaggaggaccctccggaggcccagccccaggatcaagaaaacagagcaaaacatgggtcgacctggagttgatccttaattgatgatgggcacaacatggagcctgaaatcatttatttcattttcaagtttcaggctttctgacagaggcaaagcacctagccataaattgcagaaatgcttcattgaccacggattaccatggtggggctggagccaatgtccttctccaggatgtgaatggaaatatcccattagattatgctgtagaagggacagaatccagctctatcctgttgacctatctggatgaaa

SEQ ID NO: 13252 - DNA, 3117 bp, Homo sapiens
  ENST00000375857
caaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtaaattcttctgctcttaaaatcgtcgttctcgctgctgttcagtgcagtgtactgacactgacactattgtagcaagggtcttctgttgtcttttttggcactgcttttgttgtttacttttttctatctccaataaacaaaatattctgggaaacaatgaaatacactgacaaagctcacataaaaaataattaaactgtactgaggacagtatcttggaaaccattctcatgttcctttcaaagtgtggctttccttggattaaagttttgtaaaatgattgcatgtgatatttactatttattatttaaaaggagaatgtatgtaagtgattatttccccttttatatatgaacaaaatattatttagatcagtggttggcaaactacactcatgggccagccaaatccagcctaccacctgtttttgtaaataaagttttattggaacatggccac

SEQ ID NO: 13253 - DNA, 475 bp, Homo sapiens
  ENST00000482793
tcattgaaccatttcatctcttaataacagttcctaactcaggttgtcttcaaatgtttgacaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacat

SEQ ID NO: 13254 - DNA, 6874 bp, Homo sapiens
  ENST00000356711
ctgcgctcggagactttcagtgaaagcagaggagagatttccaaaggttgtattttccttctggttggagcctctcatccacattgtggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaagctctggcccggcccagaccgcacagcgacgactacagcaccatgaagaagattcctcctcgaaagcccaagcgcagccccaacaccaagctcagcggctcctacgaggagatatcggggtcccggcccggggacgcgaggcccgcgggcgccccgggggcagcagcgcgcgttctgacccccgggactccgcagtgcgcgctgcccccggcggcgcctccgggtgacgaggacgacagcgagcctgtgtacatcgagatgctggggcacgcggccaggcccgatagcccggaccccggggagtccgtgtacgaggagatgaagtgttgcctgcccgacgacggcggcccgggcgcgggctccttcctgctccacggcgcatcgccgcccctgctccaccgcgcgccggaggacgaggcggcggggcccccaggggacgcgtgcgacatcccgccgcccttccccaacctgctgccgcaccggccgcccctgctggtgttccccccgacccccgtcacctgctcccccgcctccgacgagtcgcccctgacacccctggaggtgaagaagctgccagtcctggagaccaacctcaagtaccccgtgcagccggaggggtcgagcccgctgtccccgcagtactccaagagccagaagggcgacggcgacaggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggttcacccaaagccaaactctgcccccgtggccgggccctgcagctccttccccaagatcccatattcccccgtgaaggccaccagggcggacgccaggaaggccggctccagtgcctcgccccccgcgccctacagccctcccagctccaggcctctcagcagccccctggacgagctcgccagcctcttcaactcggggaggagtgtgcttcggaaatccgcggcgggaagaaaaatcagggaagcagaaggttttgaaactaacatgaacataagtagccgagatgaccctagtacgtcagaaattacttccgagactcaagacagaaatgcaaataaccatggaattcagttatctaattcactatctagtgctataactgctgaaaatggaaattccatctcaaatggtttacctgaagaagatggatactcacggttgtctataagtggcacagggacttcgacatttcaaagacacagggacagtcacaccactcaggtaatccatcagctgaggctctcagagaatgaaagtgtggccctgcaggaactcttggactggaggagaaagctctgtgaggaaggacaagactggcagcagatcctgcaccacgctgagcccagggtgcctcccccaccaccttgcaagaagcccagccttctgaagaagccggaaggggcctcctgcaacaggctgccgtctgagctctgggacaccaccatttgatgtggcctgaactgcagacttacaaaatagaactgcctactgattccgggctgcaacaacagaaggctgccttctgacatgcgctggggcttctctccacgcatttagacaaaaaaagcacaggacacagacactaaatatatgagatcccgtgtgtgtgtgtgtgtgtttgtgtgtgtgtgtgtgggttctttcttatccatctcgtggtgatacactctgattttcaagctcctcatttacggctctgtgctacccctaggtagcaagagagaggctgggaaaagtgtggacgtggccagagcgagagagtagcggaggaaaggagcaatccatgcacactctgtacagttgtttttctacggttcaacagtctgtttattgtacttccaatggttttattataatacagtatacgggacatatattttatttctttgtagctacttgtgttttattggtattataaacctgataattatttacatgtttattactgtaattttataaatttatgcaattggtggtgcttcctttcttcaaaatacagattttaaaaaatcatttctagattatttttttcctccacagtccttttttttcacctaacgcacctaaatcttgaaactacattgttgttttagcttcgccagtgtcaccccttgcaaaactatgaattgagccccatgttttaggtgttactcatggatgaggaggctgttctttcctatgccctgtatttctggataagtggattgtgtaccctttagttaaatttcacctcccgacttcagcatagatcacaggaaatcacatggcacacggttaaacacgtatggcttcaaatccatagccggtggtgtaaaatgatcatattcattcaaaggcctacacagtacaaatgagcacgctgccatgtactggtttgagcagtaggggctgcatcgcacagcgctcgtcccccgggacttacactgcatgattccctcactgtatatcctcaaccctcccataatgcaaggccttgttcattgatgtgctttcgtcggctgtcggaaagttctgagcagtggctccagaccaccttgtcttgctacttggaactttttattcataccagcctttgaaaagttactgtgccaataaagaggtacaactgtgttcttctatt

SEQ ID NO: 13255 - DNA, 7436 bp, Homo sapiens
  ENST00000457511
acagatcaaagatctctgattctaagaggtggctattttaagctcctgctatcaatttcctattcacacacagcaactggtggcaactaaaaataatccgctttactaccagctaagaatctggtcatatgtggctgatggacagtgtgcacgaagaagatttaggatccttctatccgtggcttctctccagcccactcatcagcttagtttgctgccatttgaaagctattgaaaagccattaacaggcaggaccgggagagccgcactgcagcacacctccgtgcagcagaatgtggctgcatgtgaacaccaattagagctgactattcccgggattgtggtactcggggctgtgtcaatcaagggtgctacaatagcacgtgcaccagtggtgcctcaagacccaccggggagaggcttatcttaactccagctgccgaatgagaatgagtttgaagctttttgcaggatcatggaacagagcctccatgcaatagtgcatcctgaggtaaactgttacctgagtaagggctttaagtaatgcatttcctgggaacgacagttgtgacagaagagaatgctggaacccgtagcaagattcctgtctgagatggaaagatgtctcactatcattttatcaagtgctgttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaagctctggcccggcccagaccgcacagcgacgactacagcaccatgaagaagattcctcctcgaaagcccaagcgcagccccaacaccaagctcagcggctcctacgaggagatatcggggtcccggcccggggacgcgaggcccgcgggcgccccgggggcagcagcgcgcgttctgacccccgggactccgcagtgcgcgctgcccccggcggcgcctccgggtgacgaggacgacagcgagcctgtgtacatcgagatgctggggcacgcggccaggcccgatagcccggaccccggggagtccgtgtacgaggagatgaagtgttgcctgcccgacgacggcggcccgggcgcgggctccttcctgctccacggcgcatcgccgcccctgctccaccgcgcgccggaggacgaggcggcggggcccccaggggacgcgtgcgacatcccgccgcccttccccaacctgctgccgcaccggccgcccctgctggtgttccccccgacccccgtcacctgctcccccgcctccgacgagtcgcccctgacacccctggaggtgaagaagctgccagtcctggagaccaacctcaagtaccccgtgcagccggaggggtcgagcccgctgtccccgcagtactccaagagccagaagggcgacggcgacaggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggttcacccaaagccaaactctgcccccgtggccgggccctgcagctccttccccaagatcccatattcccccgtgaaggccaccagggcggacgccaggaaggccggctccagtgcctcgccccccgcgccctacagccctcccagctccaggcctctcagcagccccctggacgagctcgccagcctcttcaactcggggaggagtgtgcttcggaaatccgcggcgggaagaaaaatcagggaagcagaaggttttgaaactaacatgaacataagtagccgagatgaccctagtacgtcagaaattacttccgagactcaagacagaaatgcaaataaccatggaattcagttatctaattcactatctagtgctataactgctgaaaatggaaattccatctcaaatggtttacctgaagaagatggatactcacggttgtctataagtggcacagggacttcgacatttcaaagacacagggacagtcacaccactcaggtaatccatcagctgaggctctcagagaatgaaagtgtggccctgcaggaactcttggactggaggagaaagctctgtgaggaaggacaagactggcagcagatcctgcaccacgctgagcccagggtgcctcccccaccaccttgcaagaagcccagccttctgaagaagccggaaggggcctcctgcaacaggctgccgtctgagctctgggacaccaccatttgatgtggcctgaactgcagacttacaaaatagaactgcctactgattccgggctgcaacaacagaaggctgccttctgacatgcgctggggcttctctccacgcatttagacaaaaaaagcacaggacacagacactaaatatatgagatcccgtgtgtgtgtgtgtgtgtttgtgtgtgtgtgtgtgggttctttcttatccatctcgtggtgatacactctgattttcaagctcctcatttacggctctgtgctacccctaggtagcaagagagaggctgggaaaagtgtggacgtggccagagcgagagagtagcggaggaaaggagcaatccatgcacactctgtacagttgtttttctacggttcaacagtctgtttattgtacttccaatggttttattataatacagtatacgggacatatattttatttctttgtagctacttgtgttttattggtattataaacctgataattatttacatgtttattactgtaattttataaatttatgcaattggtggtgcttcctttcttcaaaatacagattttaaaaaatcatttctagattatttttttcctccacagtccttttttttcacctaacgcacctaaatcttgaaactacattgttgttttagcttcgccagtgtcaccccttgcaaaactatgaattgagccccatgttttaggtgttactcatggatgaggaggctgttctttcctatgccctgtatttctggataagtggattgtgtaccctttagttaaatttcacctcccgacttcagcatagatcacaggaaatcacatggcacacggttaaacacgtatggcttcaaatccatagccggtggtgtaaaatgatcatattcattcaaaggcctacacagtacaaatgagcacgctgccatgtactggtttgagcagtaggggctgcatcgcacagcgctcgtcccccgggacttacactgcatgattccctcactgtatatcctcaaccctcccataatgcaaggccttgttcattgatgtgctttcgtcggctgtcggaaagttctgagcagtggctccagaccaccttgtcttgctacttggaactttttattcataccagcctttgaaaagttactgtgccaataaagaggtacaactgtgttcttctatt

SEQ ID NO: 13256 - DNA, 6874 bp, Homo sapiens; identical to SEQ ID NO: 13254
  ENST00000634397

SEQ ID NO: 13257 - DNA, 7436 bp, Homo sapiens; identical to SEQ ID NO: 13255
  ENST00000634615

SEQ ID NO: 13258 - DNA, 3492 bp, Homo sapiens; identical to SEQ ID NO: 13249
  ENST00000634825

SEQ ID NO: 13259 - DNA, 6779 bp, Homo sapiens; identical to SEQ ID NO: 13250
  ENST00000635050

SEQ ID NO: 13260 - DNA, 617 bp, Homo sapiens; identical to SEQ ID NO: 13251
  ENST00000634250

SEQ ID NO: 13261 - DNA, 3117 bp, Homo sapiens; identical to SEQ ID NO: 13252
  ENST00000635544

SEQ ID NO: 13262 - DNA, 475 bp, Homo sapiens; identical to SEQ ID NO: 13253
  ENST00000634599

SEQ ID NO: 13263 - DNA, 5563 bp, Homo sapiens
  ENST00000318217
aggctggaggcgggaccagccgctgccgtctccgtctcggtgtcccggcccctacagcgcccggcagccgcggcgggaggagcggaaactgtcgggtgcgtcccgttcggagccgcgccggccgagaaggcgccgaggagcagcgaggcggcctctgtccggcccggacccgccgagcggcgtgcgcgccccctccccgtagcctcgcggcgcggcctcgccccggcccctcccgagctcatcgcgggcccacggagcggccccggaggcccgagcgcgcccacctgagcccccgcgctggcgccatggcggagcaggagagcctggaattcggcaaggcagacttcgtgctgatggacaccgtctccatgcccgagttcatggccaacctcaggctcagatttgaaaaagggcgcatctatacgttcattggagaagtcgtcgtttctgtgaacccttacaagttgttgaacatctatggaagagacacaattgagcagtataaaggccgtgagctgtatgagagaccgcctcacctttttgctattgcggatgctgcttacaaggctatgaagaggcgatcaaaagacacttgtattgtgatatcaggggaaagtggagctggtaaaacggaagccagtaagtacattatgcagtatattgcggccatcaccaaccccagtcagagagcagaggttgaaagagtgaagaatatgttgcttaagtccaactgtgttttggaagcttttggaaatgccaaaaccaaccgtaatgacaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccactctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagccaacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattgcactgtgtgcagtttgcaacaaagaatcccgctggcatcctgtccttgggaaccctttctcattctccaagcctggtcagctgcctgcacaggcagaggtgccctcagcccagattagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatcttatttttaaaggtgttctgcttatctgtcactgaaaacttggtgaaatttttgcttaaataaagtcaaccattatctgggaggatagaa

SEQ ID NO: 13264 - DNA, 5451 bp, Homo sapiens
  ENST00000394649
ttcttcaacttcttgatttaccctaggctggggttcccaaatccagctttgtgtcatgatcacccagcttttaaaatacgcagattccccggactctgtcttctggagatggtgatttattaagcctccttagtgcccagctcaaatgaagaaatattgcaccagaagaagaaagccaagaaatgaagtcacaacgtcagtcatttaatccaccacctgtggtcctaactagttcttatgtcctgtggaacacacagtctaacaaggggataaaactaattgactccatcacatggaaaccatgatttttgccaagagaagcagaaacaagatgctttcacccttgggagagattctcatctaagaactggcaagatttgaaaaagggcgcatctatacgttcattggagaagtcgtcgtttctgtgaacccttacaagttgttgaacatctatggaagagacacaattgagcagtataaaggccgtgagctgtatgagagaccgcctcacctttttgctattgcggatgctgcttacaaggctatgaagaggcgatcaaaagacacttgtattgtgatatcaggggaaagtggagctggtaaaacggaagccagtaagtacattatgcagtatattgcggccatcaccaaccccagtcagagagcagaggttgaaagagtgaagaatatgttgcttaagtccaactgtgttttggaagcttttggaaatgccaaaaccaaccgtaatgacaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccactctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagccaacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattgcactgtgtgcagtttgcaacaaagaatcccgctggcatcctgtccttgggaaccctttctcattctccaagcctggtcagctgcctgcacaggcagaggtgccctcagcccagattagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatctta

SEQ ID NO: 13265 - DNA, 581 bp, Homo sapiens
  ENST00000577576
tggagatacacggagcccagaggaagcagggagggtggaggcaggggccaccctgctgagcgggagtcaggagagccctgcacggaggagcatgccccgattgtctgaacacgagaggtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccc

SEQ ID NO: 13266 - DNA, 1008 bp, Homo sapiens
  ENST00000577352
ataatatcaaagccatccacaactcagccggtcaataacgttttcctttttctttctctattgtgaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccg

SEQ ID NO: 13267 - DNA, 3500 bp, Homo sapiens
  ENST00000579584
gtctcggtgtcccggcccctacagcgcccggcagccgcggcgggaggagcggaaactgtcgggtgcgtcccgttcggagccgcgccggccgagaaggcgccgaggagcagcgaggcggcctctgtccggcccggacccgccgagcggcgtgcgcgccccctccccgtagcctcgcggcgcggcctcgccccggcccctcccgagctcatcgcgggcccacggagcggccccggaggcccgagcgcgcccacctgagcccccgcgctggcgccatggcggagcaggagagcctggaattcggcaaggcagacttcgtgctgatggacaccgtctccatgcccgagttcatggccaacctcaggctcagatttgaaaaagggcgcatctatacgttcattggagaagtcgtcgtttctgtgaacccttacaagttgttgaacatctatggaagagacacaattgagcagtataaaggccgtgagctgtatgagagaccgcctcacctttttgctattgcggatgctgcttacaaggctatgaagaggcgatcaaaagacacttgtattgtgatatcaggggaaagtggagctggtaaaacggaagccagtaagtacattatgcagtatattgcggccatcaccaaccccagtcagagagcagaggttgaaagagtgaagaatatgttgcttaagtccaactgtgttttggaagcttttggaaatgccaaaaccaaccgtaatgacaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagaaaccatctgcttatactctgaataaaattcaagaaagcatagattctacataaacaggcccaagattacatggcaaactgagatgaagaggatgctggctgagaaacaaacaaaagtgttcaattatttgaatgaagtaaggaaagatattttaaaatgtaaatcaacattaaaatctgaaaatggcacagttgatattgcagaaaatagaattgatgtgaaaggaaagtttgaagtctctcagtgtgcagaatttactgttataatgggcaacatgttaactttcttagcaatatacaaaataagggtacatcttacagagaaggcatcttatattcaataaaatatggtaatttaaaacat

SEQ ID NO: 13268 - DNA, 386 bp, Homo sapiens
  ENST00000580547
tgtgttcttgtcagcagttgggaggaaagggctcaaaacttcccaaggctgaggcaagaaccagctaagaggaccagagggaacagtgcccagcctcacaaagagccaggagtagtttctgatctaacaaggcagactaaagaacttcgtcattcacaggaaaccatctgcttatactctgaataaaattcaagaaagcatagattctacataaacaggcccaagattacatggcaaactgagatgaagaggatgctggctgagaaacaaacaaaagtgttcaattatttgaatgaagtaaggaaagatattttaaaatgtaaatcaacattaaaatctgaaaatggcacagttgatattgcagaaaatagaattgatgtgaaagg

SEQ ID NO: 13269 - DNA, 562 bp, Homo sapiens
  ENST00000581059
acacttgcaagttgcctggttgagtttgtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtata

SEQ ID NO: 13270 - DNA, 563 bp, Homo sapiens
  ENST00000582217
ttttaaaaagatgggggaggagccaagatggccgaataggaacagctccggtctacagctcccagcgtgagctacgcagaacacgggtgatttctgcatttccatctgaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctc

SEQ ID NO: 13271 - DNA, 621 bp, Homo sapiens
  ENST00000623444
aggaggccctgcagacgattttcaataggtaagaacgtgctgctgtgtgctgcatccatttatggtggcacagttaatactatgcaaagtcacaagtctgagaccgtgatattgactcagctatttgctgttatgacatttacctttaccttatgttttcagttttgtagatttggctttcaaagagcatctgcttacccctcaaaataaaggaactgccaatttgtttttcctgtagcagctgacagcaatgtgccacaacccctggacacaagccatagttaagataagctactagcatgctgtttctacttacttttattagctaaaaataaaaccaccacgcataactcaaactagaaaatccattaatcctttcaaagcagtggttctcaattctgctgcaccttagaataacaaggagtttaggaaatatgccagcacccaggtcctaccaccagagagtcctgtttaatggcgctggaggggtggggcccaggcagaggtccttttttaaagtttcccacgtgattttaaagtgcagccaaaggggaaaataactgtttttagagcgagctgtcttttaaataaataaaaacccaagtaaaatttggtaccttt

SEQ ID NO: 13272 - DNA, 681 bp, Homo sapiens
  ENST00000585094
tttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaataggtaagaacgtgctgctgtgtgctgcatccatttatggtggcacagttaatactatgcaaagtcacaagtctgagaccgtgatattgactcagctatttgctgttatgacatttacctttaccttatgttttcagtt

SEQ ID NO: 13273 - DNA, 558 bp, Homo sapiens
  ENST00000577252
aaacacgcccatttttccagccgaaagctctgtgcctcagacaaaattctggagtttgatcgagattttcgaattcgacattatgcaggcgatgtagtttcttcttggaatcttttatcctaccctcaacactgagtgaaccttaggcaagtcacttgacctccctacggatgagactgttagttcctgtatgttgctgttttgcttttatcttaggaatgctggatgataaatacagctatcttttaaaaagtcatcttcttgagctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagta

SEQ ID NO: 13274 - DNA, 552 bp, Homo sapiens
  ENST00000580538
tttaacctggcctggtcactgttctcttcagaattccctccttgctgtgtcctacagattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatct

SEQ ID NO: 13275 - DNA, 590 bp, Homo sapiens
  ENST00000584232
aattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaagattgattattgtgggagaaaggtaaacaaaact

SEQ ID NO: 13276 - DNA, 459 bp, Homo sapiens
  ENST00000583611
tctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaagtacagatggggtttcaccatgttgaccaggttggtcttgaactcctgatctcaggtcatccacccacctcggcctcctaaagcgctggcattgcagatgtgagccaccatgctcagccatctcaactattttgaagaagtgcatatacagatacagttttcatcttcaaagcaagtaaaat

SEQ ID NO: 13277 - DNA, 427 bp, Homo sapiens
  ENST00000582751
agtgcacagttccaccccttccatctgcatgcgtgacacattaacagtatttaaagaattccctccttgctgtgtcctacagattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtgg

SEQ ID NO: 13278 - DNA, 1916 bp, Homo sapiens
  ENST00000583621
aggctggaggcgggaccagccgctgccgtctccgtctcggtgtcccggcccctacagcgcccggcagccgcggcgggaggagcggaaactgtcgggtgcgtcccgttcggagccgcgccggccgagaaggcgccgaggagcagcgaggcggcctctgtccggcccggacccgccgagcggcgtgcgcgccccctccccgtagcctcgcggcgcggcctcgccccggcccctcccgagctcatcgcgggcccacggagcggccccggaggcccgagcgcgcccacctgagcccccgcgctggcgccatggcggagcaggagagcctggaattcggcaaggcagacttcgtgctgatggacaccgtctccatgcccgagttcatggccaacctcaggctcagatttgaaaaagggcgcatctatacgttcattggagaagtcgtcgtttctgtgaacccttacaagttgttgaacatctatggaagagacacaattgagcagtataaaggccgtgagctgtatgagagaccgcctcacctttttgctattgcggatgctgcttacaaggctatgaagaggcgatcaaaagacacttgtattgtgatatcaggggaaagtggagctggtaaaacggaagccagtaagtacattatgcagtatattgcggccatcaccaaccccagtcagagagcagaggttgaaagagtgaagaatatgttgcttaagtccaactgtgttttggaagcttttggaaatgccaaaaccaaccgtaatgacaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatgtgggattgctataatttgatagactgccttgttgatgcccagaacatcctgagttagaaccagtaaacctgttttcactttatggctgctaccacgtggacttactggtttatatctgtctgttaggtttagcatactttattaagttataccttaaattggctgaactttgcttcagaatctagtttcttcttccctttttcctcctttttctcctcttctactttgtagactatatggtattttattgtcttcagttaatgttgtttatattctctgaaacctacacattaaaatacttgttttactttgca

SEQ ID NO: 13279 - DNA, 7462 bp, Homo sapiens
  ENST00000409709
gctctgggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcagggagtgccgtgtctggctctcactgggctgctctgatcttggctgtgctgcgcctcactcaggctgggcaggactgaccccggcggggccctgttctccgtgttggtcctgcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctg

SEQ ID NO: 13280 - DNA, 4050 bp, Homo sapiens
  ENST00000409893
ggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccggtcagtgccgggaggcggggacaccagggcctgaaagtcttttggtggctgagtggtgcctctgtcaacctagcaagagattaagccaagcaggcctgggtttggcttcgctgctagctagttggtggagttaggaccttggtggagttatttcatctttctaagcctctgattccttgtctgtaaagggggaatcctaaaacaggcatcccttggagatattgcaggttcagttgaaggccacagaaataaatatcacaataaagagagctgcagaaata

SEQ ID NO: 13281 - DNA, 7336 bp, Homo sapiens
  ENST00000458637
ggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctg

SEQ ID NO: 13282 - DNA, 7106 bp, Homo sapiens
  ENST00000409619
cacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcaggagaaaagctgggacttgccccacgttacacagccacactgaggcatgtgtcgtgtcacaaacgagatcttccattcaagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccgcaggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttg

SEQ ID NO: 13283 - DNA, 5740 bp, Homo sapiens
  ENST00000481328
ttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaagggctgagtgtgcagtggctgctcgatgggctggcttgtttctttgcatcacttcatgtgcccctgggcagagtccagctccatgccagtgccagagggatccaggagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaaggtacaccatgggcttctcagagcagaggaggaggggaacagggcattgataaagcacagagactcctccctaggactgtgggaaagagccatggccttggacacctgccctggtgagggaaggagggcagcaccctcagccttgtcccagcttagcgtcttagctggggtaagtcctggggacagagggaccagaagaagctcagcctggcagtggaggcagacatgtaaacaggctggggtaatggaggatggcctgtgttctgacactggggagccctcgcccaggtggcagagctcgggaggctctgccgggtgtgagaaggcctcttagaggaggtgatatctgagctttccaggcagaccctggaaagagtgctcctggcaggggtcccacatagacaaaggcctggaggtgtgagaactcaggtctgggaaggaaatccaagtagtgagggcaggaggcgagagtgggctgtggagagcagcagcttggcaagcaggtgagaggctgggtttcctgcaggggtggcctgccttggagggttttgaacacaggtgacgtggccagaaagcctctcaggctgcgggtggaggaggggtctgaggggcacaacagaggcaggagtatggtgaggaggctggtgtgagaggatacgtatggtcttatcacacagctaggatgggaggccttttgaggagcttggctgtgcgaggagaacaggtaggtagctggaggcaggtgcagggtccaggaggctttttaaagatgggaggcccttgggctgagagggaggacaaagcagaggatggcctgggggacccaggaagggatgtggggcagcactgagggcccagcggaggtggaagccataggtcatggcagggccgtcagtaccacataggcaacaggagaggctgactttatcccagctggggccaggcttcattcctgtccccaaatgcttttcttgctctgggcccccatctgatgccttctcatctttttttctagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctg

SEQ ID NO: 13284 - DNA, 4616 bp, Homo sapiens
  ENST00000458169
ttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtgtcctccctgggcagcggcagtgaccacgtcatggacgccatctcccagtgcgagcagtacgccaaggagcagggcgcccaggagcgcaacgccccctggaggctcttcttccgcaaagaggtcttcacgccctggcacagcccctccgaggacaacgtggccaccaacctcatctaccagcaggtggtgcgaggagtcaagtttggggagtacaggtgtgagaaggaggacgacctggctgagctggcctcccagcagtactttgtagactatggctctgagatgatcctggagcgcctcctgaacctcgtgcccacctacatccccgaccgcgagatcacgcccctgaagacgctggagaagtgggcccagctggccatcgccgcccacaagaaggggatttatgcccagaggagaactgatgcccagaaggtcaaagaggatgtggtcagttatgcccgcttcaagtggcccttgctcttctccaggttttatgaagcctacaaattctcaggccccagtctccccaagaacgacgtcatcgtggccgtcaactggacgggtgtgtactttgtggatgagcaggagcaggtacttctggagctgtccttcccagagatcatggccgtgtccagcagcaggggagcgaaaacgacggcccccagcttcacgctggccaccatcaagggggacgaatacaccttcacctccagcaatgctgaggacattcgtgacctggtggtcaccttcctagaggggctccggaagagatctaagtatgttgtggccctgcaggataaccccaaccccggcgaggagtcaggcttcctcagctttgccaagggagacctcatcatcctggaccatgacacgggcgagcaggtcatgaactcgggctgggccaacggcatcaatgagaggaccaagcagcgtggggacttccccaccgacagtgtgtacgtcatgcccactgtcaccatgccaccgcgggagattgtggccctggtcaccatgactcccgatcagaggcaggacgttgtccggctcttgcagctgcgaacggcggagcccgaggtgcgtgccaagccctacacgctggaggagttttcctatgactacttcaggcccccacccaagcacacgctgagccgtgtcatggtgtccaaggcccgaggcaaggaccggctgtggagccacacgcgggaaccgctcaagcaggcgctgctcaagaagctcctgggcagtgaggagctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcaggtacagcgaggagcggggttgggagctgctctggctgtgcacgggccttttcccacccagcaacatcctcctgccccacgtgcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctg

SEQ ID NO: 13285 - DNA, 768 bp, Homo sapiens
  ENST00000467137
cggcaatggcatcctgcggccagcactccgggacgagatctactgccagatcagcaagcagctgacccacaacccctccaagagcagctatgcccggggctggattctcgtgtctctctgcgtgggctgtttcgccccctccgagaagtttgtcaagtacctgcggaacttcatccacgggggcccgcccggctacgccccgtactgtgaggagcgcctgagaaggacctttgtcaatgggacacggacacagccgcccagctggctggagctgcaggccaccaagtccaagaagccaatcatgttgcccgtgacattcatggatgggaccaccaagaccctgctgacggactcggcaaccacggccaaggagctctgcaacgcgctggccgacaagatctctctcaaggaccggttcgggttctccctctacattgccctgtttgacaaggtatggccgcccggaagcacctcctcccggaagcacctcctcccggccccactccgggctgccagtgctgccacctacttgccggggctattcacccttgagcacctcggtttccccctgagcctgtgctaattggctctgcctgactcctcaggactgccgagaactcggccaggtgcggtggttcacacctgtaatcccagcactttgggaggctgaggcgggcagatcacaaagtcaggagttcgagaccagcctggctaatgtagtgaaacctcgtctctactaaaaatacaaaaattagtggagcacggtgg

SEQ ID NO: 13286 - DNA, 2705 bp, Homo sapiens
  ENST00000605744
gctctcgcaggaggcctgcctggccttcattgctgtgctcaagtacatgggcgactacccgtccaagaggacacgctccgtcaacgagctcaccgaccagatctttgagggtcccctgaaagccgagcccctgaaggacgaggcatatgtgcagatcctgaagcagctgaccgacaaccacatcagcgcttcctgcagtcccgaaagcactgcccactcgccatcgactgcctgcaacggctccagaaagccctgagaaacgggtcccggaagtaccctccgcacctggtggaggtggaggccatccagcacaagaccacccagattttccacaaagtctacttccctgatgacactgacgagtcatcctgctgtgctccctggacccctcactgtcactcaggcttgtacaccctggcccaggactctggacgccaaggccaccttctgcttggagagtcgggaggaggagacctgggaagacccagacaggagtagccctttccttttgttaaatgccatgcccagctctgtgcccacaggagggtgtctggcacgggagggggctcagtataggaggcatagccagaggggcccgggaggaccaggtcccgggaaaggccctgcaggagcccagtgctcactgcccctcccaggccttcgaagtggagtccagcaccaaggccaaggacttctgccagaacatcgccaccaggctgctcctcaagtcctcagagggattcagcctctttgtcaaaattgcagacaaggtcctcagcgttcctgagaatgacttcttctttgactttgttcgacacttgacagactggataaagaaagctcggcccatcaaggacggaattgtgccctcactcacctaccaggtgttcttcatgaagaagctgtggaccaccacggtgccagggaaggatcccatggccgattccatcttccactattaccaggtgggcacctctgcactctagttgccttcgtgcacagctagcgttgctgtactttggccctgaaagcagagacccactgaccttgccaggtgtggggcccgtaccagcctggcctcaaagggattcctgccaagaccactggagccccaagggatggcccaacccctgatccttgtatcttctgattcttcagcccttaggggcttgacagttcctcctctgagcttccgatccctacctgttcaggcccctccttcagtgcggggctatcctctgacttcgagattctgctgttgtaactgggtaattccaaggcctctgtgcaaacattttctagcataggcacctgcaggaagccgggagggaagcttgcatgttgagcctctattatgtgtctggcactcttctctcattctgtcctcccaactaaccccaagaagcaggcatgttgtccccatttgacagagggacaaagagactcaggccgcgtgctgtgattaggatcacacagctgatggaactggggtttgattccaggtcttcatgactgcaggagttgcccaagtatctccgaggctaccacaagtgcacgcgggaggaggtgctgcagctgggggcgctgatctacagggtcaagttcgaggaggacaagtcctacttccccagcatccccaagctgctgcgggagctggtgccccaggaccttatccggcaggtctcacctgatgactggaagcggtccatcgtcgcctacttcaacaagcacgcagggaagtccaaggaggaggccaagctggccttcctgaagctcatcttcaagtggcccacctttggctcagccttcttcgaggtgaagctaggatgggaggccttttgaggagcttggctgtgcgaggagaacagcaaactacggagccaaacttccctgagatcctcctaattgccatcaacaagtatggggtcagcctcatcgatcccaaaacgaaggatatcctcaccactcatcccttcaccaagatctccaactggagcagcggcaacacctacttccacatcaccattgggaacttggtgcgcgggagcaaactgctctgcgagacgtcactgggctacaagatggatgacctcctgacttcctacattagccagatgctcacagccatgagcaaacagcggggctccaggagcggcaagtgaacagtcacggggaggtgctggttccatgcctgctctcgaggcagcagtgggttcaggcccatcagctacccctgcagctggggaagacttatgccatcccggcagcgaggctgggctggccagccaccactgactataccaactgggcctctgatgttcttccagtgaggcatctctctgggatgcagaacttccctccatccacccctctggcacctgggttggtctaatcctagtttgctgtggccttcccggttgtgagagcctgtgatccttagatgtgtctcctgtttcagaccagccccaccatgcaacttcctttgactttctgtgtaccactgggatagaggaatcaagaggacaatctagctctccatactttgaacaaccaaatgtgcattgaatactctgaaaccgaagggactggatctgcaggtgggatgagggagacagaccacttttctatattgcagtgtgaatgctgggcccctgctcaagtctaccctgatcacctcagggcataaagcatgtttcattctctgg

SEQ ID NO: 13287 - DNA, 456 bp, Homo sapiens
  ENST00000526863
ctggactgttatggggggacatgaggggcacaacagaggcaggagtatggtgaggaggctggtgtgagaggatacgtatggtcttatcacacagctaggatgggaggccttttgaggagcttggctgtgcgaggagaacaggtaggtagctggaggcaggtgcagggtccaggaggctttttaaagatgggaggcccttgggctgagagggaggacaaagcagaggatggcctgggggacccaggaagggatgtggggcagcactgagggcccagcggaggtggaagccataggtcatggcagggccgtcagtaccacataggcaacaggagaggctgactttatcccagctggggccaggcttcattcctgtccccaaatgcttttcttgctctgggcccccatctgatgccttctcatctttttttctagcaaactacggagccaaacttccct

SEQ ID NO: 13288 - DNA, 560 bp, Homo sapiens
  ENST00000481532
ggggtctgaggggcacaacagaggcaggagtatggtgaggaggctggtgtgagaggatacgtatggtcttatcacacagctaggatgggaggccttttgaggagcttggctgtgcgaggagaacaggtaggtagctggaggcaggtgcagggtccaggaggctttttaaagatgggaggcccttgggctgagagggaggacaaagcagaggatggcctgggggacccaggaagggatgtggggcagcactgagggcccagcggaggtggaagccataggtcatggcagggccgtcagtaccacataggcaacaggagaggctgactttatcccagctggggccaggcttcattcctgtccccaaatgcttttcttgctctgggcccccatctgatgccttctcatctttttttctagcaaactacggagccaaacttccctgagatcctcctaattgccatcaacaagtatggggtcagcctcatcgatcccaaaacgaaggatatcctcaccactcatcccttcaccaagatctccaactggagcagcggcaacaccta

SEQ ID NO: 13289 - DNA, 4016 bp, Homo sapiens
  ENST00000620575
ggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagattggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttcaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggcttcctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcggctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggtcctgcaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggacaccagggcctgaaagtcttttggtggctgagtggtgcctctgtcaacctagcaagagattaagcaggcctgggtttggcttcgctgctagctagttggtggagttaggaccttggtggagttatttcatctttctaagcctctgattccttgtctgtaaagggggaatcctaaaacaggcatcccttggagatattgcaggttcagttgaaggccacagaaataaatatcacaataaagagagctgc

SEQ ID NO: 13290 - DNA, 2337 bp, Homo sapiens
  ENST00000239926
ggacaggcaagcacatcagatgtcactgtttggcagctgataaaagtcagtggtgctataatactaagcacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctccccagcagcatgctggctccaacccaggccaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 13291 - DNA, 1474 bp, Homo sapiens
  ENST00000421631
gcacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttga

SEQ ID NO: 13292 - DNA, 545 bp, Homo sapiens
  ENST00000511625
acagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaagtgggcaagatgtctattttgtacaaaaggccaattaaactataaaatctaattttaataaggaagttctagctcacagatctaggtccatatatcaacaaggaataagattatctaaaaagaaggaatatttgggccctattccatttctctctgcatgaaatcacctcttggtttacagtagtaaaaga

SEQ ID NO: 13293 - DNA, 563 bp, Homo sapiens
  ENST00000509812
acagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagcaaaagaacataaaagagcaccaatgtttatctacaaaccacagagcaaaaaagttt

SEQ ID NO: 13294 - DNA, 1578 bp, Homo sapiens
  ENST00000515645
agtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagcatgctggctccaacccaggccaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattattt

SEQ ID NO: 13295 - DNA, 579 bp, Homo sapiens
  ENST00000511254
attaattctgggcttcttgctagagtggtagtatgttagtgcactgtactttaagggcttaaaagctgaatatatagaacttaccagggctgttcaaatacagccaaaataggaatgttcctttcaactgtaactacttaattctgcttcattcaagctaacaattgcatgtaaacattcttactttgttttaatttcaagcaacacaactcagaacatgcgcgactgcaagttcctacatcacaagtaaggtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttct

SEQ ID NO: 13296 - DNA, 582 bp, Homo sapiens
  ENST00000503748
aattctgggcttcttgctagagtggtagtatgttagtgcactgtactttaagggcttaaaagctgaatatatagaacttaccagggctgttcaaatacagccaaaataggaatgttcctttcaactgtaactacttaattctgcttcattcaagctaacaattgcatgtaaacattcttactttgttttaatttcaagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggat

SEQ ID NO: 13297 - DNA, 655 bp, Homo sapiens
  ENST00000508938
ggggggatgtttaattcaagaaaaccaatagctatttggcaataaatagatacagctttggaattttcaaatgtttttttcttcctagtctgactgttggtcagagacatccacttcacagaaataattcctgtactttcatttcttaaaaatttttatttcagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttg

SEQ ID NO: 13298 - DNA, 1392 bp, Homo sapiens
  ENST00000537766
ggagcccagccgggactgtcgcgcgggccgcgccggcgatgccgcgcccccgggccgggctgtagcggggccgcggctggagtgtgcgccgggcaggcgggacatggaggtggtggacgagacggaggcgctgcagcgcttcttcgaaggccacgacatcaacggtgccctggagccctccaacatagacaccagcatcctggaggagtacatcagcaaggaggatgcctccgacctgtgagtggccccctcgcccggcctgcacccgcccagccccagcccttcgcctcccttctgtcaccagggaggtctgagggccggacctggggtctgctgtggtcccacctctgaaagctgctcctcgtcccttcccagccactgactcctccgaaatctccatagttccctgcagggagggggcggctacttccctgctggggctggggtcctggctggagctgagccgccccccttccccgcagctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccagggtgagtaagggcagggagtagggggatacagcggcataggggcaggcagggagcagggctgtggccgtgacctgggaggtgctagacactggcctggcatgggatgggctgggtgactggctgtgcgtgggcaggtgagggaagggaggatgagtccaggtcaaggggggactcctgggctttgttctgaggcagtgggcagccacaaagcttctaagcatgggagtgatgagggctgacgtaagtgctagaaaaatctcgatgctgtgtggagagtggacaggaagcggcgggactggaggctgtgactgtttaccttcatgggaacacctgcatacccgtgcacgcgcgccaagcccacccacttacgcatccagctgacgtgtactgtggccacaggagctggcccatggctcagatgtggcacctcagttcccccctacccaagcaagcctcatggggcccagaacccaggcccttccccccatctttctgaggagtccacaccaagggcctgacccagggctgaaccttaggcctggctttgaccaaaggttccaggcagccacccggccagccagactccagggcagctcccggggcacatgctcacagcgggaggctgggagcatgggtctgcagggga

SEQ ID NO: 13299 - DNA, 5927 bp, Homo sapiens
  ENST00000278836
agccgggactgtcgcgcgggccgcgccggcgatgccgcgcccccgggccgggctgtagcggggccgcggctggagtgtgcgccgggcaggcgggacatggaggtggtggacgagacggaggcgctgcagcgcttcttcgaaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatccccccccagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagcctctctccttgcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 13300 - DNA, 5745 bp, Homo sapiens
  ENST00000265460
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatccccccccagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggcaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctg

SEQ ID NO: 13301 - DNA, 2052 bp, Homo sapiens
  ENST00000389602
atctaaccactccagtggtggggtctcctctccacactgcagcctccaggctgccgccctcctgggctccggggcctgctccgggacggccgcaggaggggttcattcccgggcctggctccccgcaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctcttt

SEQ ID NO: 13302 - DNA, 1067 bp, Homo sapiens
  ENST00000536352
gtgaggacgacgtttgtcacttacctgtcctgagtctgggcgccaaggaggcatgtaataggtctccaccccagctgaatagtgaagtgctgacatctgagacaccagtcatccgaggggcagatcccggggctgcagccttcaggcttaggagaggagagctctggcagggagtggggagggccattcaggcaggtgggacagcccaggtgaaggtgcagaggtggaggtgttgctcggagacaggcacaggagctgtgggagccgaggctggattggaggggcccgcccaggtagggagactttgagggcctcccagtggccaaggacagtggccgcccctcctgccccctgatgtctggcagcctggggctcccggggctgactgggccctctgtgttggcccatggcccatggcccatggcccatggcaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcaggtaggggtgcggggtgggggaaggtgagacccttcttcccagggacacccctgatcctggccctcttgctgcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatggtccagccagagctttgggaccacgcagctccgacagtcccccttgaccacggggctaccaggcatacagccctctttgctgctgg

SEQ ID NO: 13303 - DNA, 1844 bp, Homo sapiens
  ENST00000537318
gtgaggacgacgtttgtcacttacctgtcctgagtctgggcgccaaggaggcatgtaataggtctccaccccagctgaatagtgaagtgctgacatctgagacaccagtcatccgaggggcagatcccggggctgcagccttcaggcttaggagaggagagctctggcagggagtggggagggccattcaggcaggtgggacagcccaggtgaaggtgcagaggtggaggtgttgctcggagacaggcacaggagctgtgggagccgaggctggattggaggggcccgcccaggtagggagactttgagggcctcccagtggccaaggacagtggccgcccctcctgccccctgatgtctggcagcctggggctcccggggctgactgggccctctgtgttggcccatggcccatggcccatggcccatggcaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatgggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcaggtacttgctgcacccctgacactacccagcccagcctggcaaggctcactggccagggcccacctcagcccagtcatgtgactgtctgggttcagacttgtcagtcaatagacgtttgctgagcacagaataaggatcaggaatcaggcctgcagccttacatagatcatcccatttagtcctcacagcactcctgcaagaaaggaattgttgttcctattgttcagctgaagaaatgggatggagactaaggtgaagtgacctgcccagggttatacagcccctccgaggcagggcttgtatttgatcccgagcctggctcctccttcgccatgccagcaccaggagggtgctatactgggtctcccctactatttcccaaaccttggatctttggttttaacaaagctacagaaccttttattgtagttttcaaactgggttcctctgaggtaccctgggggctgcgctgggggctgccctggggg

SEQ ID NO: 13304 - DNA, 645 bp, Homo sapiens
  ENST00000546247
gtggctccagcgtggtgtccatgtccacactgtacgtgctgagcctgcgcacagaggaggacctggtagacactgatggcaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgc

SEQ ID NO: 13305 - DNA, 3324 bp, Homo sapiens
  ENST00000539361
cgtttgctgagcacagaataaggatcaggaatcaggcctgcagccttacatagatcatcccatttagtcctcacagcactcctgcaagaaaggaattgttgttcctattgttcagctgaagaaatgggatggagactaaggtgaagtgacctgcccagggttatacagcccctccgaggcagggcttgtatttgatcccgagcctggctcctccttcgccatgccagcaccaggagggtgctatactgggtctcccctactatttcccaaaccttggatctttggttttaacaaagctacagaaccttttattgtagttttcaaactgggttcctctgaggtaccctgggggctgcgctgggggctgccctgggggttgaaggggaggctgggaggcttcctggcttcaaccaggcagctctgctctcaccaactttcatctgatggattttgtggcttcaagaaaaagaaagcctggaaaatgtggcttacagagatggaaattcaatgtgatgggggaaccccatgggggagatgtttgccaggcacctgtttactgagctgcctgccactctgtggctggctctgtacaggggactgggggtgatgaagatggacacgcccctgtccccaaagacctcacagagatgaaaacacagcagtgtgatgaggctctgaggggacatgcaggtagctttgggactggggaggacacttaatccggacgaaggtggggaggatcagggaaaacttctctggagttggtgacatttgagctgactctttaaaggacctttggaatttgcccagaagggatgtgggaagggcaccttccatctcgtctgtatctgatacctgtcctgaccacacagggtgtcctggatcctgttggggtccttgggtccctgggtcatgcctcagagctgaaaacgtaccaggtccagcaaatgttcagcggccccagcttcccccttcctgggtggatagtcaggcagcagcaagactgtatgtgaactagatgagcaagaagtcctgtctcccccatctgacttgtcacacttcagtcccacccctacccagccagccagcctgcagtcggtttgttcagggaggctgcgaggagcagcgtgctggtagcggtgtaatcatcggcctcggggcagaggggagcctgatttgtgtgatgctgtcaacactgctgatttcaagctaccagtgtaactgatgtttctgaacccagaactgggagagatgcccgcagtcaggaacacaggcctcgagcgggctcctgcacacctggcaggggatgtgaagacccatccctacttctgggtgttccagttcttttgaggaggcagacgtcaggctcatgggaactgggtagtcctagggctgctgaggaaagggtgtagtgtgatgctggccattgtggaggtctggaaaaaaataacctggaacttattcatactaaggtgtgagtgactgcttcaagtctggcaaggaaagacttgccagcttctcatttgtgtcctgccttgtcaccttactcctgccccaacagcctctctccttgcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaagtgagtgccggtgtggggaagtgggaggcaggaggggagccagggagaatctcccgcagagcctcagaacagccgagtctgaggacagccggagagtctctggtatttcctgcatggtgggataagtgctgacttcattgcctacttcgtggttaactggctaaatgacctggcctcatgggctgaggaccacatgggatggtcgatgggaaaggttttgttcgagggccctggttattatgcggtgtttcaggctgggtggagattcagaggcgtgtggcaggctggctgggagggggctggggttgagggactctagaacctcatttctctgctaactgggcctgtctacagctcctcctcccccgtgtctgtggtgctgtgcagcctgaggtcaaaggaggaaccatgtgaggaggggagccttccacagagtctccacacccaccaggacacccaggtaggtgggactgggaagctgcgggccggccaggcccgagctgcttctctcctggcacaactgggccccaaaatgggcaaggagcagaagctgggagttatagagtaaagccttctccacaagggacactctggggcctgggcctctgtgtcccagggaggggcacgcgtgcccgtgtttgttcattgcactctgctgagcatctcccagccctgccgtgctggagacgtggggaagacagcagatcacaggtgctaatgtggatgagtgcaatgatggaaacaggcaggtgtctgggagcccatggcggggagggctgtggctcactggaggtgtctgcagaagcaggaaggagccgacctcatgctcaggttggggaagtggcacagctagatgtacagcatcagagggcccctcaggttccatgtttggccacctcttctgggagaactggatggtgagctcctccctggccaggtaaccggaagttatgactgtccctggggctgatggacccccagtttcttcttgagcctaagaggccatgggagaagacgctcaggacaaatgaagggaagtagtgattattttttcttgcccattcatgtgtttactcagaaaatattgattggggccccatctgtcccaggccctgtgctgggtgggcctagctgcaggggagagaggtggagtagacacaggttttgacttccaagaacgtactctatagtgagggagaaaagacgtgcagaaagcacctgcaacagaggtgggggtgcttctgagggaggcccgagccctgtcgccctgcagaagagacagggtccaagacagagggagagcccagctagacacacagcagacatggtgctcgggcctgaaaccacatcacagacgcacagccaaagcctcaggtagatgggcaagctgcctgcagccaggctgcatgccaccctgtgagggagacagccagacagacctgggtttgaatcccagctgtgtgattttgccacactgtgtgatttttaggaagtggctcagtttcctcatccagaagatggggctagtagcagcactgtgtcactggattgtactgaggatggggctaatgaaatactttgatgt

SEQ ID NO: 13306 - DNA, 2678 bp, Homo sapiens
  ENST00000444716
aacccggcggttccgcagctgtgtttgggagacttgggggcgcattagcctggacagctccctgatcggtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactga

SEQ ID NO: 13307 - DNA, 5077 bp, Homo sapiens
  ENST00000302541
ggccaggctggccctggctgcctgcggcgcgggcgcctccctcgcagccgctgctgccgacgccgctgcgctcccgcctcctgtcggttcccgggttcccgctgcggctgcggttctggcagccgagcccccgcggtgctgcagcccagctttagcgcgcagaccgacccgcgccccttcttcgccgccggcagcctctaatccacgcggcgcgttgcggcaggtgccctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaacaaaaaacaacaaaaaagaagcagcagcagcagcctgctgtgtggcatctgaacttttataaaggtttccttgtgccaaataagtgcaaagatttaatttactattaaaaaccataagcatatgttatagttccagaagaattattttgtcatcaagtgattttgatctttagtgtcaatatttatatttagattaatttttataaatgaaaatattttaatggtttaagaaaatgaggacaacaggataatatctttgatgacttctgaaagttatgcttcccttcatgttatatgcacattgccaagaattactgtcaagagaaatgataagtaaaagtcatttatgaaaataaa

SEQ ID NO: 13308 - DNA, 2981 bp, Homo sapiens
  ENST00000425621
ctgcggctgcggttctggcagccgagcccccgcggtgctgcagcccagctttagcgcgcagaccgacccgcgccccttcttcgccgccggcagcctctaatccacgcggcgcgttgcggcaggtgccctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaaggtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagt

SEQ ID NO: 13309 - DNA, 3144 bp, Homo sapiens
  ENST00000458441
cctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgc

SEQ ID NO: 13310 - DNA, 3244 bp, Homo sapiens
  ENST00000458292
cctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgc

SEQ ID NO: 13311 - DNA, 961 bp, Homo sapiens
  ENST00000475082
agcttcatcccgggttcctcctcatactccctttccgccacagccgccagacttgaagaggtagggagccaatcccagggggctctacatagatttggaggtaacggcggaggatcttcctgatggacgcgtggagcggaaagattcagtggtgggaaccccaagacctgcggctttttggagcacttgctccccttcttgttccttaatttactgacgtcttggcagggtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggtaaagttgcttaagagtttacagctactgggaagttggagtaatagaaacacctacaggtacaggtactgccagggtcccccagatgcattgttaccccagatgcaactatctactactgtgtgtgagtctccctgggtcacttattattg

SEQ ID NO: 13312 - DNA, 4153 bp, Homo sapiens
  ENST00000459828
attttgatgtcctcaactgcagtaggagccatctccctgacttgttctgacctgacttgttccctaccgtaatctcctggatgcagaagtccctcaggcccatcgggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaac

SEQ ID NO: 13313 - DNA, 622 bp, Homo sapiens
  ENST00000482033
agaaacgagcagtagcactgtgctgttccttcactctggtattgctctctacccagagccctgtgtcttttcttaagaagactacctggcttatcctctgtctgggcttttctggccatgaggacatggagtgaagattttggagctctgtgccctgtgtcctggcgtttaattatttctcaagacacgtgagctaaatttgagtagaagagcttggcagaaagaaaaccaccagttacggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacg

SEQ ID NO: 13314 - DNA, 4877 bp, Homo sapiens
  ENST00000396217
gccgacgccgctgcgctcccgcctcctgtcggttcccgggttcccgctgcggctgcggttctggcagccgagcccccgcggtgctgcagcccagctttagcgcgcagaccgacccgcgccccttcttcgccgccggcagcctctaatccacgcggcgcgttgcggcaggtgccctgggcgtactgaggcgcggtggcctgagcccggccgccatcgatgaccccggtcgcggacttgcttcaggctggccaccccccgtcttgtttcatcatctgtgttgagtaaccatggggaggaagctggacctgtctggtttgactgatgatgaaacagagcatgttcttcaggtggttcaaagagacttcaatcttcgcaaaaaagaagaagaacgactaagtgagctgaagcagaagctggatgaggaaggcagcaagtgcagcatcctctcgaagcaccagcagtttgtggagcactgctgcatgcgctgctgctcgcccttcaccttcctcgtcaacaccaagcgccagtgtggagattgcaaattcaatgtctgcaagagctgctgctcctaccagaagcacgaaaaggcctgggtctgctgcgtctgccagcaagcgaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaacaaaaaacaacaaaaaagaagcagcagcagcagcctgctgtgtggcatctgaacttttataaaggtttccttgtgccaaataagtgcaaagatttaatttactattaaaaaccataagcatatgttatagttccagaagaattattttgtcatcaagtgattttgatctttagtgtcaatatttatatttagattaatttttataaatgaaaatattttaatggtttaagaaaatgaggacaacaggataatatctttgatgacttctgaaagttatgcttcccttcatgttatatgcacattgccaagaattactgtcaagagaaatgataagtaaaagtcatttatg

SEQ ID NO: 13315 - DNA, 4635 bp, Homo sapiens
  ENST00000539167
agaaacgagcagtagcactgtgctgttccttcactctggtattgctctctacccagagccctgtgtcttttcttaagaagactacctggcttatcctctgtctgggcttttctggccatgaggacatggagtgaagattttggagctctgtgccctgtgtcctggcgtttaattatttctcaagacacgtgagctaaatttgagtagaagagcttggcagaaagaaaaccaccagttacggcttctgagggcccaatctctggaatggttctacaataatgtgaagagccgcttcaagcgctttggcagtgccaaggttctgaagaacctgtacaggaagcaccggctggagagtggcgcgtgcttcgacattctaggaggaagcctttttgagtcaaacctggagaatgaaggaagcatttctggcagtgattcaacattttataggcagtcagaaggacatagtgtgatggacaccttggctgtggccctacgggtggctgaagaggccattgaggaagcaatttccaaagcagaggcatatggggacagcctggacaagcaaaatgaggccagttacctgcgggaccacaaggaggagctaactgaggaactggccacgacaatcctgcagaagattatacgaaaacagaagagcaaaagtgagcagcaagtggaagaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagacccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggccaaacctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccaaccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagttggccagcagggagacctcggacagcagcgagccggaggaggccccccacaccacagaccggcgggccaggaggtggagaagagcccgactgggctcagaagagccaagcaaagaaccatcttcccccagcgcccagctccgggatctagacacacatcaggtgtcggatgatttatcagagacagacatcagcaatgaggctcgggatccccagactctcacagacaccacagaggagaaacggagaaacaggctgtacgagttagcaatgaaaatgagtgaaaaggagacttcttcaggggaggatcaggagtctgagcccaagacagaatctgagaaccagaaggaaagtctgtcctctgaagacaacagccagagtgtccaggaagagctgaagaagaagttttctgctgtttctctctgcaacatctccacagaagtcctgaaagtcatcaatgccacagaggagttgatagcaggatctacagggccctgggagtccccacaagtccctcctgacagacagaaggggatgtttcctcgtgggacagaccaagtgagactggatgagcagctgacttccctggaagaaaatgtatacctggcagcaggcactgtgtatggactggagacccagctgactgagctagaagatgccgcccgctgcatccacagtggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaacaaaaaacaacaaaaaagaagcagcagcagcagcctgctgtgtggcatctgaacttttataaaggtttccttgtgccaaataagtgcaaagatttaatttactattaaaaaccataagcatatgttatagttccagaagaattattttgtcatcaagtgattttgatctttagtgtcaatatttatatttagattaatttttataaatgaaaatattttaatggtttaagaaaatgaggacaacaggataatatctttgatgacttctgaaagttatgcttcccttcatgttatatgcacattgccaagaattactgtcaagagaaatgataagtaaaagtcatttatg

SEQ ID NO: 13316 - DNA, 2061 bp, Homo sapiens
  ENST00000360149
cggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcaggtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtacgttgggccatgctggctctttcattgcattgcggaattgagattttcgtgtgttttataatgtaaaaaaactcctactagattcccttttcattaatacaacgggtcacctaactgaccaacgccaa

SEQ ID NO: 13317 - DNA, 5535 bp, Homo sapiens
  ENST00000328439
ctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgatgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtgaa

SEQ ID NO: 13318 - DNA, 624 bp, Homo sapiens
  ENST00000610671
gaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgctctccagcaaggatccagctgtgactcagggcatggctcaaggacagtgatggcgtagggtgtaggcaaggagggctatgcagttgtagtgggaacttcatttgggggtgcttgtgttttactctcaaaacccaacctttttcttttgaatctggtggcgagaatgtacattttaatgggtctgttatagacaacttgctgagcacctccgctcatattttggctcccgcaggattatcagtgctctgctgatccatgttggagcctggggcacaaggaagagtcagtaatatggatcctgtctttatttaaggttttggtatcttgtttattaggggttttttgcatcatgttgatgtttctaaatattgaattaaaatattatttatcttga

SEQ ID NO: 13319 - DNA, 2140 bp, Homo sapiens
  ENST00000622439
ctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcaggtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtacgttgggccatgctggctctttcattgcattgcggaattgagattttcgtgtgttttataa

SEQ ID NO: 13320 - DNA, 5614 bp, Homo sapiens
  ENST00000536311
ctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgatgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtg

SEQ ID NO: 13321 - DNA, 2061 bp, Homo sapiens; identical to SEQ ID NO: 13316
  ENST00000616597

SEQ ID NO: 13322 - DNA, 5535 bp, Homo sapiens; identical to SEQ ID NO: 13317
  ENST00000613234

SEQ ID NO: 13323 - DNA, 624 bp, Homo sapiens; identical to SEQ ID NO: 13318
  ENST00000630159

SEQ ID NO: 13324 - DNA, 2140 bp, Homo sapiens; identical to SEQ ID NO: 13319
  ENST00000621996

SEQ ID NO: 13325 - DNA, 5614 bp, Homo sapiens; identical to SEQ ID NO: 13320
  ENST00000616648

SEQ ID NO: 13326 - DNA, 7063 bp, Homo sapiens
  ENST00000399161
ggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgatgagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacgaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttccccggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtgccccacgcctggctgtgatggttctggacatatcaccggcaattatgcttctcatcggagcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtgggggcaataaatgaggttttttgcattccaaggaaatggcatatggattaactgtaagaaatgaaataagtaatttattgtaagacaacatcaagccatggaaacttggcagaagattcaaagcagcttaaacagcacttttaaattaactcctaagcgttacatggttgtgactatggaaactccagttaagacaggatcttatcagaggtggacaacgtgaagatttccttttccattttcaataaactttggaacaaccttctcgtatctcccctagagtttcgtgcccctctgaactgtctgttattgcaatgtagtttatcaacagaatttgtgtgttttcgatttaagctaaaagataatttaagaacatttatttccccttttcactttaaaaaattatgattattcctattattgttatgaaccttcttattttacatttgagggataaaggcaaatgatttgtgagtcttctagttactggaccgagttttctgctggatctggtgggaaggcagctcggtaaagtttccctcctgctccccccgcccgactttgactctgaatcagcatttggtcctattcagaggactcttaccacgacgtttctgttctacacttgggtggagaccagttgaccatagagcatttgcagagcctcattgtttgatttcttgtgactattctaagaatgaatgcaatcagattttaaaagtaactaaatatacttcagcacttttttgctttaaactagatcatcttagacttgtttataccttccagatttgattgttttactcccaatgactgcactatatgtatgcataagaccacttttgagcgctgtgttcccccttctgagtagtcctttgacgacgtgttgtgttttctgatgttgacttgagttccatttagtagcatctcttccttccatgtcttgatgttatgcaggaagtacagacgtactttaaatttttgttatgaaataaaaaaaagatgggttttgtaaaaataaaaaaaaaatatttttagcagaacaggacttacagggtcattgtccccacaatgtgccagtcgactatttgcacttaccttgtcctatatatccgtacggaggtgtgcaattcctcgtgtcagtagccttgtgacactgaacctggatggattatagaggagccctcacggctgatcaataatgttgcaaagggagactacagggatctcacgacgaatattctgatacaatactcaacctcggtatatatatatgtgtataaatatatgtatatcccagcggcactttatactgttcactgtacaaaagcttacagttttccacaaggactttaataactagctgggaaaagacgatgtaattatttcggggctctgcggaaccttctctgtacagcgccccctttctgttgtgctattggttgcagctgccatgctcagaatgcgttttgagagctgaagcaaggtgcttgcagtcacctgaggccgtccgtgtggcccagggccccagctgcctttagggcccccattgttcataacagcatatgcatttccccaccgcgttgtgtctgcagcttctttgccaatatagtaatgcttttagtagagtactagatagtatcagttttggattcttattgttatcacctatgtacaatggaaagggattttaagcacaaacctgctgctcatctaacgttggtacataatctcaaatcaaaagttatctgtgactattatatagggatcacaaaagtgtcacatattagaatgctgacctttcatatggattattgtgagtcatcagagtttattataacttattgttcatattcatttctaagttaatttaagtaatcatttattaagacagaattttgtataaactatttattgtgctctctgtggaactgaagtttgatttatttttgtactacacggcatgggtttgttgacactttaattttgctataaatgtgtggaatcacaagttgctgtgatacttcatttttaaattgtgaactttgtacaaattttgtcatgctggatgttaacacatcttactctaaataaacaaggtgttgccacatttgtagcacgaaggatctctaa

SEQ ID NO: 13327 - DNA, 3642 bp, Homo sapiens
  ENST00000407844
aagcgcctggaagcggaagctggacagacgaggagaggccttgggtgtgacatcaacggaacctgagggaagcaaaactcagcaaggacgcacccggtctgctggactggggctttggcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcaggtaacaattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtgggggcaataaatgaggttttttgcattccaaggaaatggcatatggattaactgtaagaaatgaaataagtaatttattgtaagacaacatcaagccatggaaacttggcagaagattcaaagcagcttaaacagcacttttaaattaactcctaagcgttacatggttgtgactatggaaactccagttaagacaggatcttatcagaggtggacaacgtgaagatttccttttccattttcaataaactttggaacaaccttctcgtatctcccctagagtttcgtgcccctctgaactgtctgttattgcaatgtagtttatcaacagaatttgtgtgttttcgatttaagctaaaagataatttaagaacatttatttccccttttcactttaaaaaattatgattattcctattattgttatgaaccttcttattttacatttgagggataaaggcaaatgatttgtgagtcttctagttactggaccgagttttctgctggatctggtgggaaggcagctcggtaaagtttccctcctgctccccccgcccgactttgactctgaatcagcatttggtcctattcagaggactcttaccacgacgtttctgttctacacttgggtggagaccagttgaccatagagcatttgcagagcctcattgtttgatttcttgtgactattctaagaatgaatgcaatcagattttaaaagtaactaaatatacttcagcacttttttgctttaaactagatcatcttagacttgtttataccttccagatttgattgttttactcccaatgactgcactatatgtatgcataagaccacttttgagcgctgtgttcccccttctgagtagtcctttgacgacgtgttgtgttttctgatgttgacttgagttccatttagtagcatctcttccttccatgtcttgatgttatgcaggaagtacagacgtactttaaatttttgttatgaaataaaaaaaagatgggttttgtaaaaataaaaaaaaaatatttttagcagaacaggacttacagggtcattgtccccacaatgtgccagtcgactatttgcacttaccttgtcctatatatccgtacggaggtgtgcaattcctcgtgtcagtagccttgtgacactgaacctggatggattatagaggagccctcacggctgatcaataatgttgcaaagggagactacagggatctcacgacgaatattctgatacaatactcaacctcggtatatatatatgtgtataaatatatgtatatcccagcggcactttatactgttcactgtacaaaagcttacagttttccacaaggactttaataactagctgggaaaagacgatgtaattatttcggggctctgcggaaccttctctgtacagcgccccctttctgttgtgctattggttgcagctgccatgctcagaatgcgttttgagagctgaagcaaggtgcttgcagtcacctgaggccgtccgtgtggcccagggccccagctgcctttagggcccccattgttcataacagcatatgcatttccccaccgcgttgtgtctgcagcttctttgccaatatagtaatgcttttagtagagtactagatagtatcagttttggattcttattgttatcacctatgtacaatggaaagggattttaagcacaaacctgctgctcatctaacgttggtacataatctcaaatcaaaagttatctgtgactattatatagggatcacaaaagtgtcacatattagaatgctgacctttcatatggattattgtgagtcatcagagtttattataacttattgttcatattcatttctaagttaatttaagtaatcatttattaagacagaattttgtataaactatttattgtgctctctgtggaactgaagtttgatttatttttgtactacacggcatgggtttgttgacactttaattttgctataaatgtgtggaatcacaagttgctgtgatacttcatttttaaattgtgaactttgtacaaattttgtcatgctggatgttaacacatcttactctaaataaacaaggtgttgccaca

SEQ ID NO: 13328 - DNA, 670 bp, Homo sapiens
  ENST00000399157
gaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggaggatggtgtatggtgggggcaataaatgaggttttttgcattccaaggaaatggcatatggattaactgtaagaaatgaaataagt

SEQ ID NO: 13329 - DNA, 4850 bp, Homo sapiens
  ENST00000428368
tttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccaggagtagagcttagagcgagcccctgactctgggcctgcgtcctgccaggagtcacgctgcctccgttcctaggagagaagacttcctgtaagatggaggtggacaccgaggagaagcggcatcgcacgcggtccaaaggggttcgagttcccgtggaaccagccatacaagagctgttcagctgtcccacccctggctgtgacggcagtggtcatgtcagtggcaaatatgcaagacacagaagtgtatatggttgtcccttggcgaaaaaaagaaaaacacaagataaacagccccaggaacctgctcctaaacgaaagccatttgccgtgaaagcagacagctcctcagtggatgagtgtgacgacagtgatgggactgaggacatggatgagaaggaggaggatgagggggaggagtactccgaggacaatgatgagccaggggatgaggacgaggaggacgaggagggggaccgggaggaggaggaggagatcgaggaggaggatgaggacgatgacgaggatggagaagatgtggaggatgaagaagaggaagaggaggaggaggaggaggaggaagaggaagaagaaaacgaagaccatcaaatgaattgtcacaatactcgaataatgcaagacacagaaaaggatgataacaataatgacgaatatgacaattacgatgaactggtggccaagtcattgttaaacctcggcaaaatcgctgaggatgcagcctaccgggccaggactgagtcagaaatgaacagcaatacctccaatagtctggaagacgatagtgacaaaaacgaaaacctgggtcggaaaagtgagttgagtttagacttagacagtgatgttgttagagaaacagtggactcccttaaactattagcccaaggacacggtgttgtgctctcagaaaacatgaatgacagaaattatgcagacagcatgtcgcagcaagacagtagaaatatgaattacgtcatgttggggaagcccatgaacaacggactcatggaaaagatggtggaggagagcgatgaggaggtgtgtctgagcagtctggagtgtttgaggaatcagtgcttcgacctggccaggaagctcagtgagaccaacccgcaggagaggaatccgcagcagaacatgaacatccgtcagcatgtccggccagaagaggacttccccggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatgatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatgcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtgccccacgcctggctgtgatggttctggacatatcaccggcaattatgcttctcatcggagcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcagcttgtcaggatgcccgagagccacgtcagcgatgaagaaggcaaagctttctggagagcagatgctgaccatcaaacagcgggccagcaacggtatagaaaatgatgaagaaatcaaacagttagatgaagaaatcaaggagctaaatgaatccaattcccagatggaagccgatatgattaaactcagaactcagattaccacgatggagagcaacctgaagaccatcgaagaggagaacaaagtgattgagcagcagaacgagtctctcctccacgagctggcgaacctgagccagtctctgatccacagcctggctaacatccagctgccgcacatggatccaatcaatgaacaaaattttgatgcttacgtgactactttgacggaaatgtatacaaatcaagatcgttatcagagtccagaaaataaagccctactggaaaatataaagcaggctgtgagaggaattcaggtctgaacagctgctgtagtgatgaaactcttgcttaaaaaggatgcctcttgttttttgctgctgtaacttaccagaaagtgttctatatttatttctgtttgaatttgaaacagtgttatgcttacaagacttcataatgattttatgtcttgctttaaagatagtacctgcagaatagtttttgaatacacccacattttgtacgtttccatgtaagctgacatagtgttctgccatgtaatgtttatagctgctgatgtatgcacatttgggggtatatctatttctgaagaggtaagctgatcaaaataaatagagtgtaaattctttttaatgctttagtgattaaatgttttagtattttgaactgaaatggacacacaaacacacacacgcacacacagacccacagctttgaatgatcatgttgtggctgagcagccgctttttagacgttatcattttgcctcatgttggaggactttatggaatttaagaaatacattttgtgtgcatattgtttcatagcaagaattcgttgcaaaaatgctttatttttgaacaatgcttggaaatattatgtgacttttttgtttgtttgttttaggaggatggtgtatggtggggg

SEQ ID NO: 13330 - DNA, 3206 bp, Homo sapiens
  ENST00000471668
agcggaagcgcctggaagcggaagcgcctggaagcggaagctggacagacgaggagaggccttgggtgtgacatcaacggaacctgagggaagcaaaactcagcaaggacgcacccggtctgctggactggggctttgggttggtgacgtggacgatgagtctaattttggggcatccgcgcagttgtgcagcggtcagtggggtgcaggggtggacgtgaggtcaacccacgccggcctcagagccccagcgacctgcaggcaggtcaggagccagagggtggggcgggggcggaggaggccaagggaggaaggaaaggtcgggggaagcacaggcgggcccctctttccagattccctcctttaagagggcggggagaagaaaggccccagcaggcagcgagctcaggtgccctcgcctcgccgcctctttcctcttcctgtgaagagcgagacaggggaaggagcaggaggattccccgctggctccaggaggtggggcagcaggggcctgggagtgaaggcgctgtggggccctgacaacctcctttctgcccagacacgaaacccgaaccttcccgaaccttcccacacccgcctgtgctgaggtgctgcccccacctgaacagggaggaggatggccaaggcctgggaggcaggatggagcctccctttaggggagtgagcacttcctcctgggaatctgcgtgtttccaagaatcagaactgaccaagaaaactatccccgagctcaggaaagccagggagaagagtggcctcccacctggacccacccgtgtgccagcgccgggcccgcgatttccacaagacccaatagcatggcaggagattgcccaatttctggttcttcaattcttttccaaaaatcccatttgttttatgtattattttatgtgatgtgtatgtgtgtgtatgtttctgttccagctgaaaaaattccctttacaaacatgtccaaagcctctgtacccaagaggttgaaaattaaataaaataggcgtgtccagctcccactctcccgtctgcaggcacaacccgaagcctggaataagtcactagcccatcactgtctcccaagacacgaacctgagatggaagtgcttgggaagctgctgtgagagacagagtacccaagaatggggctgggaggctgcttttttctgccatgttcacccccgacatgcacgcatccgtgtgcgctcgctcccgcgctctctgtcaacaaaacctcccccagcgtctttcctggtgactcccgactgcttctgctccctcccggtggaccagtttctctcccgttcacagcatcctagcccaccccagtctcccaactttcttgaaaggggactgacggtgcctagagccttggagaggacacagggaaagaactctcctcctgaattttgactttgtgcccagaagcacaggttttggagagaatcaagtcacagcctcgtcggttaagaaagctcactggggcggattacgaggtcaggagatcgagaccatcctggctaacacgatgaaaccccgtctctactaaaaaatacaaaaaattagccgggcgtggtggcgggcgcctatagtcccagctacttgggaggctgaggcaggagaatggtgtgaacccaggaggtggagcttgcagtgagctgagatcgcaccactgcactccagcctgggcgacagagcaagactctgtctcaaaaaaaaaaaaaaaaaaagaggccgaggtgggcaaatcacgaggtcaggagatcgagaccatcctggctaacacggtgaaaccccgtctctactaaaaaatacaaaaaaattagccaggcgtggtggtggccgcctgtagtcccagctacttgggaggctgaggcaggagaatggcgtgaacccgggaggcggagcttgcagtgagccgagatcacaccactgcacttcagcctgggtgacagagtgagactctgtctcaaaaaaaaaaaaaaaaagaaagaaagctcactgaaatcaacggtgtggggtgctttctgaaatgtgtttcttatttagcctttcaggttgcccaagagcaaagaaaagtggtatcaggatagcacagagcaaagaagataaagaagatcaagaacccatcaggtgtccggtccccgggtgcgacggccagggccacatcactgggaagtacgcgtcccatcgcagcgcctccgggtgccccttggcggccaagaggcagaaagacgggtacctgaatggctcccagttctcctggaagtcggtcaagacggaaggcatgtcctgccccacgccaggatgcgacggctcaggccacgtcagcggcagcttcctcacacaccgcaggagctgaggcacccatggggagctgaggacaaggtggccgtgtgcagcccctctggagcacggcgtctgcagggacccctgggtgctgccgacaacaggggtccaccctgggacggaaccaactggcaggaccccggggtcctctcgtctacctctcaccctacaatgcaggccccaggcccccagccgggcagtgaggccctgtgcatacactggggcataggaacgggacagggccaccccctggggggccacagctgtcactgtgcgctcactcagtggccttgaaagaagcgcctgaagcgagagaacatgggtgacggggtttccctgaagtcaagtcaaagcagccaacgtgcaccatgtccatcctcattttatgcgccttcgtcttggcgtagcctcagcagctgcttttggctgtggcttttaagctgtgaaagtatttgctgggaatgtccttggctcctcacgcagcacctcctccccgttaggctggtttctctgctggatctaaaacaggagggaggaagcatcgtgagtggcgtgggggggcttgagcggctcctccctctctcctctgggggtgcccaccggggcccaaagcttctgggaacccggcggagagctctgctcctgagccaggaattgccaggcaccacacaactgctatccgcggggcctgtccggtttccccaagtgcttctgcttcattcgctaatccatacagcgtagctcagaatgatcgcttgccttgggtccccaaacactacctgagctggaaagtgcttgtgtgatgtgttagtaatggataatacaaaatttttaacatggga

SEQ ID NO: 13331 - DNA, 1848 bp, Homo sapiens
  ENST00000602387
caggagaggaatccgcagcagaacatgaacatccgtcagcatgtccggccagaagaggacttccccggaaggacgccggacagaaactactcggacatgctgaacctcatgcggctggaggagcagttgagcccccggtcgagagtgtttgccagctgtgcgaaggaggatgggtgtcatgagcgggacgacgataccacctctgtgaactcggacaggtctgaagaggtgttcgacatgaccaaggggaacctgaccctgctggagaaagccatcgctttggaaacggaaagagcaaaggccatgagggagaagatggccatggaagctgggaggagggacaatatgaggtcatatgaggaccagtctccgagacaacttcccggggaggacagaaagcctaaatccagtgacagccatgtcaaaaagccatactatggtaaagatccctcaagaacagaaaagaaagagagcaagtgtccaacccccgggtgtgatggaaccggccacgtaactgggctgtacccacatcaccgcagcctgtccggatgcccgcacaaagatagggtccctccagaaatccttgccatgcatgaaagtgtcctcaagtgccccactccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaagcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagacattcttgatcatggacaaaacaaattttccagataaactctcgctcttggatcctctaagctcttaaacttcctgagataacactttgcctggtcttacccaaagcagcaaacatgggacgttttgaaaagaaaatccatcacttcattgtctaattatgtataatatgtaaactgaaactggattaaaatttaacgtgcacctgaatctta

SEQ ID NO: 13332 - DNA, 399 bp, Homo sapiens
  ENST00000470954
caaaaaggacttaataactctgtctggctgccccctggcggacaaaagcattcgaagtatgctggccaccagctcccaagaactcaagatccctgtccaaggccctagggccctagatcacctgcttatgttcagtgacttcctgaactagctctttcgccacaagacccttggaactttcttcatggaatgtaaacgcctggagggcttcctcttacctaacggctgtaaagtctgtagcctcatccaaaacagtgcctcatggaaaagtagatttaggatctcaaaacggacagcattagcaagagcagttcaacccactttgttcaggcgtcttttgtatggctcgaaaccacatttccctcatggtcaaaacatgactaactccacttggaactt

SEQ ID NO: 13333 - DNA, 1080 bp, Homo sapiens
  ENST00000490585
ctcccaaggtgcaaaccagggatatatcccccaaaggatatgatgatgcgaagcggtactgcaaggaccccagccccagcagcagcagcaccagcagctacgcgcccagcagcagcagcaacctgagctgcggcgggggcagcagcgccagcagcacgtgcagcaagagcagcttcgactacacgcacgacatggaggcggcccacatggcggccaccgccatcctcaacctgtccacgcgctgccgcgagatgccgcagaacctgagcaccaagccgcaggacctgtgcgccacgcggaaccctgacatggaggtggatgagaacgggaccctggacctcagcatgaacaagcagaggccgcgggacagctgctgccccatcctgacccctctggagcccatgtccccccagcagcaggcagtgatgaacaaccggtgtttccagctgggcgagggcgactgctgggacttgcccgtagactacaccaaaatgaaaccccggaggatagacgaggacgagtccaaagacattactccagaagacttggacccattccaggaggctctagaagaaagacggtatcccggggaggtgaccatcccaagtcccaaacccaagtaccctcagtgcaaggagagcaaaaaggacttaataactctgtctggctgccccctggcggacaaaagcattcgaagtatgctggccaccagctcccaagaactcaagtaagatttaatgacaataattctcttttaaaaatccatgcactcagtagttcacaaaaaaaaatgatatgtcatttgcaaagaaaaatgtctgttaaaaaacatggcctgtgcaccccagtgccttgatgtagacatgggattgaatcctcggaatttcagccacttttccacacaacccattctgccttttcccctgacatacctccagcttgttcatatcatatccttcctatctgggatatcctaaagcatgggtgttttctcttcagatatgcatgcatatggaagggaaattttacagttactcaaatttttagaaaatgactgtaaataatcaaaatttaattttt

SEQ ID NO: 13334 - DNA, 734 bp, Homo sapiens
  ENST00000485547
actccgggctgcacggggcgcgggcatgtcaacagcaacaggaactcccaccgaagcctctccggatgcccgatcgctgcagcagagaaactggccaaggcacaggaaaagcaccagagctgcgacgtgtccaagtccagccaggcctcggaccgcgtgctcaggccaatgtgctttgtgaagcagctggagattcctcagtatggctacagaaacaatgtccccacaactacgccgcgttccaacctggccaaggagctcgagaaatattccaagacctcgtttgaatacaacagttacgacaaccatacttatggcaagcgagccatagctcccaaggtgcaaaccagggatatatcccccaaaggatatgatgatggtaggaggtgcacactcttatacatgagagacacgttgccattgatgatgttgttgttgtgtatatcaatgtcctacaaattagttgagcggtggtggtcactcaatgggtaccaaaagaacaggactttcatagcacagcccaggagctgaaagcccctcaggtccacacagctgtaggtgagcaaaacttcaggggaaggaaggagatggtttcccctcaataattccgagacagcgcactcggctgctcgtggaatgtggagagggagaagctatggactggcttattgtcttttgtggtactgggaagacagtgcccttatgttatacgcttcctttaaataaatgcctct

SEQ ID NO: 13335 - DNA, 430 bp, Homo sapiens
  ENST00000485348
cgtggaaccagccatacaagagctgttcagctgtcccacccctggctgtgacggcagtggtcatgtcagtggcaaatatgcaagacacagaaggaaccagtgagaaaggcgaaggacagagttccaggatctgataaaagcattaagtcagctccttagagacgcagacactcttggcagcgaaggaaaactgtttccatcccacacattgcccagcagggatccaagcttactcaacatttttgggccctgatacaggtcatcaggccagacctcctaggaagctaacaaatatgacaaatatttatcttcagaaacgtcattattagccagtcacctgaatttgccttttgcttttcccaactgaggtttttgtcttgtgatattagcatataaatgacaaaaacacggtgaattttataagcagggc

SEQ ID NO: 13336 - DNA, 632 bp, Homo sapiens
  ENST00000479156
agtttcctgtctgaaagcattattacttttgtccatgtggcaaaataattagcatacagatgagaagtggccccttgcctgggcgccggtagagagagaagatgtgcagtggaaagttgattggatgaatggagaacaaatggtgggcgttcaaaagcattagaagagttttgtagtcgtggagcaggttggagaattttctggggcgggtcatgaggaggctgtagccaaggacgaggtgtgtgcggctgttgcctggacgtttgtccaatccacgttgacatttgagggatcacagcgtgtgaaaatgaactcagaggagaattggtgaattcctatccagtgggcatcttcaaaccctggtcgacggcggaagaatatcaggtcctgagatcacccacccggcgcggcaacagtgcagagtggccacatctggtggaagaagaaaaaaatgtagttattgaattcaatcaagtgtttgcatctttcaagctatcaacaaaattccatcaagaaaggttccagttggtctcacagacgtatggatatccgaggagccacctaaagatggagaaatcaaggcatagagagattaagtgactttgccacagtcacaagctggagaggaccag

SEQ ID NO: 13337 - DNA, 546 bp, Homo sapiens
  ENST00000476547
ttttagtcttactgtaaggagtattgtgttgtgagaagatggaatggtacaggacattctcttaaagctttccttgctttcagactgcagtggtgtctagcagggctcgatgggaagggaattgcagcctctatagtaaccagtaagtctggtcccaacacatcagggaagagctcggtcttcagaggaattacctctgagagctggaagagggtgttcctggtaacttggggcttctctgtcagtctccccacggaaaccacagtcagagctgtgctctgtggaaagcctgcagtggctgctccctcgtgctgttctgctctcgactctcactcactgtggatagtgggctggtggagtgcgggcgccagagggtaggggtgaatggaatggaaacacagagggaactgtgaccagcacgtgcgatggtctctccacggcagacagagccctgcgtgggtgagaagcagactgcggaacaggatttggcttgatggccaccagctcttccacaaaaagggcgggtcatgaggaggctgtagccaa

SEQ ID NO: 13338 - DNA, 1045 bp, Homo sapiens
  ENST00000460585
actaaacagtgagagagcttttccctgcagtcttgttgaagcaccccgggttttttgctcattgttggtgggtgcattttaattttttcattccctggactatgggttatgatatccatactcactgaagacaaaaagccaccttttctgcgtcttggtggcatgcatgtgtctcatcatcctttcaaacttgtggtggaacagggttttcttccctgtctgtgtattttgagccagcacagttaccaaaattgaacttgtctttcgcttgtgagcggttgtggtcattgtgagggcaaaacctgggatgaggaaaagagtctgggcacaaaattccaggagtcttcacactcgggttcatggcaaagaaagaagcctttgaccttgctcctgttccaggatcagaaatgtcaccattcagattttaaaatgaaggggtcattgacattaagtgggacagatgaacactggctcccgaagatgccattgtccagaaataggcagccatttggggtcttcaagagacacttctaatgagaaatacaaaacagaaatcttgggattgctgacaactacccgcagctgggacaactgtggttaagtcaggacacttcgatgtgacgtgttgctcgatgtttttcaatgtgtgcagcagaagtcggggaagattcttccttgaatgtcgcgttacatacgttgtcctctgagaaggaaggtggctatccttggcaatggtttctattataacacaactatgaactgtggtcattttcagacaagctgcttccctcctcccggcccttggtttgtttggtgttaaacgtctcctcttggtttctgtgggtaaatgaattgttcttaacacggtgtcctctaagatgtgtgctctatccagtggggcctgctgagaactgcctgaacacagtccgtacgctgcctaagtgcactcctgtggctaaaataaatctcagccctaatgactagatccctcatcctgacccaagcctgattaagagagcagggagactctgtaacagtgacatgt

SEQ ID NO: 13339 - DNA, 1260 bp, Homo sapiens
  ENST00000334982
tttccttcccaggtgtcgccgcctgctttctgcagccgctgcctgggaggggttccgaggttctgggcagccacagccccggaggccttacaggagcgacctggcaattcccgccgccggccgccagaggaagctgctttgctgctgtcgttgcccagcaactcgtagcccggaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaa

SEQ ID NO: 13340 - DNA, 1222 bp, Homo sapiens
  ENST00000484480
ggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattcctggatccactttaaaaaaacaacagggcggtatgtgaaaactaaggacaaagtggttccgattcaagtgtcaggaagatggaaagaactatgggataagatggctgggaacatttcaaagagggggtgagccttgaagatggataacacattgtaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaa

SEQ ID NO: 13341 - DNA, 920 bp, Homo sapiens
  ENST00000310450
ggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaa

SEQ ID NO: 13342 - DNA, 1036 bp, Homo sapiens
  ENST00000463154
ggcgggcgcggggtcttggcgaacggtcttcggaagcggcggcggcgcgatgaccacgctacgggcctttacctgcgacgacctgttccgcttcaacaacattaacttggatccacttacagaaactgactctagtatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaa

SEQ ID NO: 13343 - DNA, 1000 bp, Homo sapiens
  ENST00000480550
ggtcttggcgaacggtcttcggaagcggcggcggcgcgatgaccacgctacgggcctttacctgcgacgacctgttccgcttcaacaacatgactctagtatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaa

SEQ ID NO: 13344 - DNA, 1604 bp, Homo sapiens
  ENST00000398602
cggcgcgatgaccacgctacgggcctttacctgcgacgacctgttccgcttcaacaacatgtgagtgacacgcgcctagggccagccgctcttggccgggcctcgcttcccggccccgccagctccggccccagccgcgccttcccggccggaccccaagcccggacggggacccgcgagaaccaccccccgccggccaacgtgggcgcctccctggggccacagggtccagggagaggtgggcctggagtcgacgcacgccggccttggcgaccttggccgaggtgctcaaactttgtctctggaccctgcgagctggcaggttctggggcagcgctcgggcctccgctcgtggtcgctgtcaggaggcgctggggtgatggggcgagctggagacgcggcctggagcccacgacctgggcttctcgccctgccctactgcttgctggttcgtggccgggccgcgcctcttctgggcagagggcaccgccgacggccaggccgcagagggggcttgcgaggatcggaagctggtcagcagctgttgggatgtgtacatcgtgaagcccacctggtggccgtggttaaattgtatccaaatgaaatgacactgatcactgcgtcccctgcagcagatgctgtctcagtcatgtaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaatgttttctgaagtttgttagtcattt

SEQ ID NO: 13345 - DNA, 600 bp, Homo sapiens
  ENST00000481837
acgacctgggcttctcgccctgccctactgcttgctggttcgtggccgggccgcgcctcttctgggcagagggcaccgccgacggccaggccgcagagggggcttgcgaggatcggaagctggtcagcagctgttgggatgtgtacatcgtgaagcccacctggtggccgtggttaaattgtatccaaatgaaatgacactgatcactgcgtcccctgcagcagatgctgtctcagtcatggttagtgtttgcaagtttagttactgtagctgcgcaccccggtgtacacacctttcctctgtgaggagtcacggcagatcttaggggaggctcgctgtgcccagagccctggatgcagtttctttggattcgagttaaggccagacctctgatttgcagtaacttggatccacttacagaaactgtatccttttttacaaaaaaaaaaaagttgaatgaagatttactgagaataaagaaaacagaaatgaaaggaaaacagaggagtactgaaaagtttaaaaacttgtaggtcaggaaacatcataagcaacactgaaagcaattttaaaaagtgaaactgagaacaagagttgtct

SEQ ID NO: 13346 - DNA, 2711 bp, Homo sapiens
  ENST00000300131
ctctcccagtctctaagccgcggcgtctccgcggccgagaggccccagcgcccgcctccccggcccccgcccccacccccgcccccggctctgcccacgccctccgcccgccagcccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttagga

SEQ ID NO: 13347 - DNA, 591 bp, Homo sapiens
  ENST00000555857
gtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaacagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgc

SEQ ID NO: 13348 - DNA, 2318 bp, Homo sapiens
  ENST00000342556
gggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttagg

SEQ ID NO: 13349 - DNA, 791 bp, Homo sapiens
  ENST00000554718
gtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaaggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggg

SEQ ID NO: 13350 - DNA, 569 bp, Homo sapiens
  ENST00000554839
gcggccgcagtgcttccatcctcagctgagggggaagcagagatacaggcagcaccgagctgttcagctccttgtcactcaggaccccacaggagaggaggaggccccgggcattcctaggaagctgtgggtgctgacctctgtcttcccacctcagaaagctcccatgtagtgtcaaaaccaaagcaagcgtctgatggatgggcctcatttgtccaatggtgaaggggtgtgaggaggtctggtgaggcagcggggaagttcgaattctgactctcctggctgccctccctccacagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggag

SEQ ID NO: 13351 - DNA, 385 bp, Homo sapiens
  ENST00000509434
ggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagagaccatggttgactgaaggtaactgaaaccacgaaaagtgacagcacagatgaggggagagtactgtatcctcaaatgatggtatggctggtgatggtaacagcaagtctaccagcctagtcaagcattcttatccatagaagagttgccatgggaacctcatggcaacccacagatttcaagtactgtatgttctgcctaaataaataatgaaaagct

SEQ ID NO: 13352 - DNA, 1604 bp, Homo sapiens
  ENST00000422287
gtgtcttttggctcctccgcgtgtagttacctgagaaacgcgggaagttgggcccaggcagtgttgctgcggttgcctaagttgtttttctatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaaattgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagaggccttagattttagtgatgatgaaaaagagaaggaagccaaacagaggaaaaaatctcagattcaaggccggaaaaaactcaaatctgaatttaatgagcctggtacaggtatatctcacagatattgtggcctcggatccagaccattgcagtcaagtgagtcacacaaactttttggtttccaaatgcatataaaagttacgtttacatgctactttagtttattaagtatgcaatagcattgtgtctaaaaaaaccaatgtgcatatctcaattggagaatactttactgttcaaaaaataataatgaccctttgagcctgcagtgagttacagtcttttagctgttggaaggtctggactcaagtgctgttggccgctgactaatcagggtagttgttgctaaaagtggcagtttctcctaatagatagcagtgaagtgtgctacattaattggctcttcctttcaccaaagatttctgtgtagcatgtgatgctacttgatagcat

SEQ ID NO: 13353 - DNA, 1907 bp, Homo sapiens
  ENST00000274054
cggaaagcgttgctgcgtaaatggcgggggcgtgtcttttggctcctccgcgtgtagttacctgagaaacgcgggaagttgggcccaggcagtgttgctgcggttgcctaagttgtttttctatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaaattgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagaggccttagattttagtgatgatgaaaaagagaaggaagccaaacagaggaaaaaatctcagattcaaggccggaaaaaactcaaatctgaatttaatgagcctggtgaagattttactgaagtacatcagaattggaatgctcatagctctgcttcagagcatgcaaaaggatatcgtaacagagaattcacacgaggattttccagggccagataccctcgatcttgccatggcaggcctccacctcagcatttctataactcagaacatatggtatctcaggagacttcaggatttccttctcagagacaaaataatcccattatgccacaatacccctttcctcttccagtgtttgacatgcataattttcccctccgccctccacccccaccaccacccccacctgtaaacatgggttgggctacaccaaacatggctgctcatccattacttaacttaccatactccctacccccaccccctccccctccaccactgcctcctccaccctcttctggagatagtaattctcattttggaccttactattaggtgactatgcatttccagagaaatgtggacttttcatattatgtggtaaggatttttttttttcaagagtgattatggagctagatttttaaaaacactgtaaaatactaaatgattccttctgttgtaagttgatatatatttgtaacctttgtgaaattgtattcatatgaaaatgtcagctcaaattcttgggagaacattaaattatgtaatatttaattaaaa

SEQ ID NO: 13354 - DNA, 718 bp, Homo sapiens
  ENST00000509884
ttttgaatgaatgaattatggaacattgtcttctgttttttattggctctgataatatatataatttgcttagtccttgatactcttacctttggcacccttttgcatctgatactatgatgaattttaagtctaaactggaagtcagactcatatctgaaggctgattactggcctgtgttaattaaagtcattaagcatttatcaaaaaatgctttatttttataccatgtctaattcagatatagaaaatattaagtatcaaaaagacaactttttttagagtcattgatgcataataggcttattttcttcacctccaagtatgtactattgaattggcaaattcatgtaacataaacctattatatacttttctctgcaaggccttagattttagtgatgatgaaaaagagaaggaagccaaacagaggaaaaaatctcagattcaaggccggaaaaaactcaaatctgaatttaatgagcctggtgaagattttactgaagtacatcagaattggaatgctcatagctctgcttcagagcatgcaaaaggatatcgtaacagagaattcacacgaggattttccagggccagataccctcgatcttgccatggcaggcctccacctcagcatttctataactcagaacatatggtatctcaggagacttcaggatttccttctcagagacaaaataatcccattatgccaca

SEQ ID NO: 13355 - DNA, 2329 bp, Homo sapiens
  ENST00000509232
agtgttgctgcggttgcctaagttgtttttctatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaaattgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagagacatgggggtctcagtgtgttgcccaggctggtctcaagctcttggcctcaagtgattctccagccctcaagcaagcttctgccttggctccccaaagtgctgggattacaggcatgagccccttgcccagccagtattacagatttttgatacttaccgatttaaccttggccattttagatgtttaaagcaatcgtaaatcatgatctgtgtttctaattttactgaggtatgaatcaggtttatgcccacttggagggttctatacaggtatgaatcacttaaccagtgaatgatccttgcttagtatctgaattgaaatggaattatgttttctaattaatgttatgtatttatgtgatttcagttaaggctctgaatattcacttaatgttctgaattaagttttagagtatctatagcatcttattactggaattacatgttttaaacgtgtttagagattcataaacatctcaaatcatatttcttttaaaatccagatattctttttttctttttttgggtaggggatggagttttgctctttctgcccaggctgcaatgcagtggcacggtctcagctcaccgcaaactctgcctccgggttcaagcaattctcctgcctcagcctcctgagtagctgagattacaggcgcatgccaccacgcccagctaattttgtatttttattagagacggggtttcacaatgttgtccaggctagtcttgaactcctgacctccagtaatccacccctctctgcctctcaaagtgctgagatttcaggcgtgagccaccgcacctggccaaaatccagatattctaatgaatccctcttgtttcggacctaagcattgaagttaccaattacaacaatgcgagttatttgtaaaattggtttgactaggttaattgcaaaattacatctcacctagttcatggtgtttgttttttccaggtagcttgaactggatcattaagtatcttgggatttaattttgtaatatttgttggtgaaactttgtagtctagaattattgcctggtattgatcatagattaaaattagaaatttgtgaggtttaaacttaaaaagagaaaaaggagaaacattgcgtgatgtgaaaatagaaagcttgcataaaggaaaataagagaaattatgtgctatgaaatgttgggctgcataaaggacctaaaaattacctacggttgtatcatgttcatcttcatagccatttttaatatgccaccgtatactttatggttgaataaatgtatttaatgaatgg

SEQ ID NO: 13356 - DNA, 1159 bp, Homo sapiens
  ENST00000502973
ccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaaattgagaaggaaaataagaattttcctcttaaaacaaaagatgaattacttcttaatctatagagaaaaaaaaaattcagtcatggctctcagtactccagggattggatcctactttccaaccatatctgaaaagtgaaggctcacctaatagcatcaggtaagaaaaatgaaaccagaaagaaagagacttgtctgaagtcatattagtggggaggagcagatctgaactggtaatagatacattccaaactgctgtgtttttagtatttgtggagacctgcatagcaacgttggaatctggtcgtttggactttctcattatttggtttctgaataatcatgtagcatattttctcaaagtgaaggatgaatgtatcatctaatgtaagctttttaaaattgtatttgcttggattatattgcctctcaataaagcttttgacttggaactgtgtagtgtgtgggaaataaatggtggagcttctttagtatgttgaattttagtagttcatttgcgaaatgctgtggtgtttggggatgtttatttccatgcaagcttttcatttgctaatgatgtgaatgaaatagttttcttcctttcctttcctactctttgttatgtgtagaagtattgaataaatgagtcca

SEQ ID NO: 13357 - DNA, 928 bp, Homo sapiens
  ENST00000603491
tttgaagacgttgttggttgtggaaactggggaagtgctaccagaatctagtgaatagaggctaaggatgctgttgctgaacagcctctgatgcacagaacagcccccacccccaacaaagaataatccagcctcaaatgatagtgttgctgttgagaaaccccgatctagagagaaagcagctttgctagggaagatttgagcagggccccatgaataaacccaccagagtgagctgcagctgtgagttccaggcttggaaccttccgtgcctgtttagtgccctcaaatttgagcccatacccttcggcacacacactaagacttccttccatgatcaagccctggcttacccttcagcctcatctcccactgagttttggtcacaccagaccatcaacatcccagatactccaaagtccttgcccttgaggaaggagattccataccctgtctggaatgctctccttccacttctgtctgacagatactcactccccattccctgttctgcatccagctgtggcatatttgagaagccttctttcattgctatcctgcatcttccttgttcctggggtagcacacagcctctctttcatagaacatcacacaagacagctgctgggatggctgacttgtgtatctgtctctcccaccagactgtgggttctctcaacagggtgaacatgaaaaatagaagcctccagtttctcctgatagtgtatagatgggcagatctggcctcaatggcagaagatacttggggaactggagaaagtacagaaggtgatgtgaaatcaattgggtcatcaaaagaagacgggtgtaccacaatttgttcctccacctgctgcccatgaacatttggagggtttctagtttttggctattacaaataaagttgtcatgaacatttgcatacaaa

SEQ ID NO: 13358 - DNA, 509 bp, Homo sapiens
  ENST00000605377
gttccagggggttcctttgaaaacttcctgcggtgtccaggagcgagcagcctgctgcacacaggacgcaatgcctgctgaaatcccagatgaaaattcataatccacttaggaaaaaggaggggggatgcacggagttagcacatattaagtgcctgctgtagtcaagccctgttggacaccagggacatctggaccttgacaacggagcgaaggggtggtcctgcctgcaccaggtttcagactgtgggttctctcaacagggtgaacatgaaaaatagaagcctccagtttctcctgatagtgtatagatgggcagatctggcctcaatggcagaagatacttggggaactggagaaagtacagaaggtgatgtgaaatcaattgggtcatcaaaagaagacgggtgtaccacaatttgttcctccacctgctgcccatgaacatttggagggtttctagtttttggctattacaaataaagttgtcatgaacatttgcatacaaa

SEQ ID NO: 13359 - DNA, 458 bp, Homo sapiens
  ENST00000604237
cagagccgaaatcccagagcagtgaaagaggagccagtgtcatggggcttctggtttcaggacacactggaaagggtccagccactttgtcacaagctacatctatggcgagcaacgactcccggctgcagggtgagacagataagaggataagagggagcaggagcagacggagaaagaaggtggcaagacagagcagactgtgggttctctcaacagggtgaacatgaaaaatagaagcctccagtttctcctgatagtgtatagatgggcagatctggcctcaatggcagaagatacttggggaactggagaaagtacagaaggtgatgtgaaatcaattgggtcatcaaaagaagacgggtgtaccacaatttgttcctccacctgctgcccatgaacatttggagggtttctagtttttggctattacaaataaagttgtcatgaacatttgc

SEQ ID NO: 13360 - DNA, 2133 bp, Homo sapiens
  ENST00000604258
gaatttgtcagccaggacttaccaggacttgtgatagaacaaaattgccagtggggaacttgaggctcattcctcatagagaaccaacaggctccaaatcaccaaacttctttgcctctctgggaaaactaaatgacccaccacttcagaagaaggtcatggggtctgtgcacagcttttcacatcctccctgaaacaccaacacgcccggtccaggttaaaggatatcagcactgccacacactcttctttttcccaaattaatcaagaagtaggaatttctgacaaatgccatctgctgatttttcagagagacaagttttggtggtgtgaccagcaggtgcctcggctttttctagcatgcagtaccaaaatagtcaccatggcaaccctgggagggcagacttccaaagagatgcattgtgagctcagaaactctagagcactttcaagctaaaaggaaggaggctcagcagtgggtttccaactgtgcctccttccttggttcacaatgacagtccaacttctgccagtcctgactgtcattcaagcctttttgctatttaagaattttgaggaagaaaaccgtcatgtactcaaaatcctggtaatcagaagtgtctggagatttcgagctgttaacatagagaggtggcaaaattattttctgggatatccttatgggcctgaatggcagcgggagtcgacatagctggtgcctgggcaggtttccaaagcacagccgaggtggagagtaggtgagggctgcaacaaaggtcccgacatctgaagagcactgcacagtttgtcagaggatttcagctccacactctcacttagtcctcacagcaaccccatgcagtgactgctgtcacttcttttcatggctgagaagactgttgggagaggaaaaatgaattgcccactggcaggcaggtaagaggcacagctgaaactctcacctagttcttctgactccaagcccatcatctcaggattgtacccaagtggctcttgcaccagtatcagcgccaatggcagggtcagcagaaaatagcagaggggcctgaaaacagatgggaacatctggaaaaggcagtggggagctgttgagagcattttgagtggggcagtgacactgctggctctgcattttggaaaggtggttttcagagcagtttggatgatgctggggagtagctgacaggttgaagatcagtcctgaggagcagattcataatccacttaggaaaaaggaggggggatgcacggagttagcacatattaagtgcctgctgtagtcaagccctgttggacaccagggacatctggaccttgacaacggagcgaaggggtggtcctgcctgcaccaggtttcagctgaccctccctgcatcttggtcccagtggcttctcaggcttctctgcagcatgggtgttcctgccttggccagagccgaaatcccagagcagtgaaagaggagccagtgtcatggggcttctggtttcaggacacactggaaaggctggtccctgagtgctccaaggacccatgcatctgaccataggggatgctgggagtatcctccatcctggcctgaaagagctccctttcagcttcctggattcatatctgtctttctgaaaactgacttcccatattcccaaagccatcgccagctcccagctttgtcattcaggaaaaagagtatgcacctccccttcatcctcctcatctctcaccatcattaagtacaagcccaaggagaagaatcaagggcaatgaatcttcatcaaacaataaaatcctgcctgggtccagccactttgtcacaagctacatctatggcgagcaacgactcccggctgcagggtgagacagataagaggataagagggagcaggagcagacggagaaagaaggtggcaagacagagcagactgtgggttctctcaacagggtgaacatgaaaaatagaagcctccagtttctcctgatagtgtatagatgggcagatctggcctcaatggcagaagatacttggggaactggagaaagtacagaaggtgatgtgaaatcaattgggtcatcaaaagaagacgggtgtaccacaatttgttcctccacctgct

SEQ ID NO: 13361 - DNA, 1748 bp, Homo sapiens
  ENST00000605707
taggcacaatccttgtttcagcttaaatgttttccccaacatgccactcagataacacaaggtagagccatggtttgaacagaaatgtcttccttcaaagtttcagctcttgtcctttcttccacccacccccatcccacctactcatatgactatgtgttgcatgaaagcacatacgtgtgcatatagaaaaaagattcagatggggaggggaatatagctggagaagtatagattgattatggattggtgactggtgaaaagtatttctgccagaagcccccacactacaaaatgtaatcctattaatgtgtgtcatctaaaaacatatattgtatcctagctgtaagaatttctatttaatgggctacaaagacaaattttggagatcctaagcaatttgagtctcttattcttctagtataatcaaacagtgatccactttcttggccttcccccagaatccttgctcccatggcaagtttttcagcccaactggtggaaattgttttgtcctgattgagaggtattaaagaaaaaatatctaccccagcaccttagttttctaaatcacttgtctttgcttgtttcctagcagcatgaaatactagtctggagaaatagatttagaattagtttcaattgccatttattgatcacaggtactatgcatacaattttcataaatggtcacatttgattttgattctcatcaaaatgatttctatttagcaatgaagaactgagggtctaatggattaggagacttgctcaatgtaccctgttagtaaggggacagaataggaactggagctgggctctgcagaattcatggcctggctctttccacagtattcacattctctccaggcagaagatacgatctgcctaaatacttgctttccaggccatccactagttctgctgtatcctgggaacctgcaggaccagccaagcccaggacagggccgcctggggccagggcaggtagacttacctggaagagcaccagcctggctatcagcatatccactttcttcccatttccttttgcagcctccttccttggttcacaatgacagtccaacttctgccagtcctgactgtcattcaagcctttttgctatttaagaattttgaggaagaaaaccgtcatgtactcaaaatcctggtaatcagaagtgtctggagatttcgagctgttaacatagagaggtggcaaaattattttctgggatatccttatgggcctgaatggcagcgggagtcgacatagctggtgcctgggcaggtttccaaagcacagccgaggtggagagtaggtgagggctgcaacaaaggtcccgacatctgaagagcactgcacagtttgtcagaggatttcagctccacactctcacttagtcctcacagcaaccccatgcagtgactgctgtcacttcttttcatggctgagaagactgttgggagaggaaaaatgaattgcccactggcaggcagattcataatccacttaggaaaaaggaggggggatgcacggagttagcacatattaagtgcctgctgtagtcaagccctgttggacaccagggacatctggaccttgacaacggagcgaaggggtggtcctgcctgcaccaggtttcagtggcttctcaggcttctctgcagcatgggtgttcctgccttggccagagccgaaatcccagagcagtgaaagaggagccagtgtcatggggcttctggtt

SEQ ID NO: 13362 - DNA, 701 bp, Homo sapiens
  ENST00000604009
ggattcagctcattgtgctctaaggcaactttcatagcagaaatgctgtgatttggtaattctaagcatctgaaaatgttttctttggcccttggccatcccaggatgtttgataaaatctgatcatttggataagtcccagaaaaggaacagatcagagcctgcgttgggtgctgggagcccacctgatgggagaatgtgtgtacatgtggcggggaatagggagcatggtaaagtgtggagactgagaactagaaagaattaaagattattcaacttgttccaaatatagaaactgagccccagagaaggaaatgattcgttcaagttcatacagctagttaaaggcagaactgggattagaattaatccattcctgggttttttcccctacaatgaggatgacaaatacatttccttttctgccctctgatcaattagcagtggctaccttgagcactgacttctggaaggttcccaggttcttcaaaattcagcaagaagaatgctgattgattagcaatgtctgatatggccacaggaaaggagagtacccagaatttgtcagccaggacttaccaggacttgtgatagaacaaaattgccagtggggaacttgaggctcattcctcatagagaaccaacaggctccaaatcaccaaacttctttgcctctctgggaaaactaaatgacccaccac

SEQ ID NO: 13363 - DNA, 551 bp, Homo sapiens
  ENST00000605043
cagtgccattttgtgggaacttagatccaatatatccctgttcacgggtcccacaatgcttagaatgatgcactgccctgaggagtttgacagacgtggcagaggagagaggcaggagggaggaggagaagagacacttaacaagtgtctgtgaggtggcgtttacatttagaattccctttcctttcaaaggaatctccaggatagccaaagagtccagcttaaaggtagccagccagaaaaagtgcccaaaccacgcagtgagatcacacctttgaagaccccaccttggcatagactctacggctttcacgaatgatgctgagctctcagcagcaccagaacctcaggctctgacacccacaaagctgcaggtctccagggctgcttgggccaaaaggacattggcactggatttagagcccaccagataatttgggatgatcttcttcatatcaagatccttcacatctgcaaagatcctttttccatataaggctccaaatcaccaaacttctttgcctctctgggaaaactaaatgacccaccac

SEQ ID NO: 13364 - DNA, 4582 bp, Homo sapiens
  ENST00000222553
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattagtgaagtgttaaa

SEQ ID NO: 13365 - DNA, 671 bp, Homo sapiens
  ENST00000463871
agggatacgttatgaaataggaaagcctttaccttagtaatactcttgttccctctccaaagattgtgtgtgtggttttggcgtagttggtatagttgggcttttcttcaacagcatgtacatgctgtgcttactgtcagtttaaaggcagtttgtaatataaagagataccttaagggtcacatgttagaatgctcacagacttcctacaaatggagtattaggtgttcttcagtggcaaaaaggatatccaagatgtcatactttttctttattacaaacgactatccttcaaaacaggctaaagtgttatgtttctgaaagccagatgtggattggttcagttatacctattaagtgcttaaaacttaaatgtaaattatgtatgtgcttttttgtaagggagtgtttagacatttctgatgattagtcttctacttgtctaactttcttaatttggatttcagattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaa

SEQ ID NO: 13366 - DNA, 1213 bp, Homo sapiens
  ENST00000354289
gagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagaggtatgtgttttatattaaaagtttcaataaggcatttcttataattaagtttgtttatgtttgataaagaacacaatataaatacaa

SEQ ID NO: 13367 - DNA, 1009 bp, Homo sapiens
  ENST00000491027
atttttctccttcctcgcagccgcgccagggagctcgcggcgcgcggcccctgtcctccggcccgagatgaatcctgcggcagaagccgagttcaacatcctcctggccaccgactcctacaagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggtaaattttcatatgtaactttattattagaatccctctgtaggccagctgcatcaatactacttttcatttatatacacacaatttcagagctgtgtggaccagtcccctttattttagagttgcagcccagagagagtaatagatttgcctgaggtcacacagtaatagcacagaaggataccaagacttatggattgttttactgtcaattagacatttgaatagatattt

SEQ ID NO: 13368 - DNA, 318 bp, Homo sapiens
  ENST00000467730
tctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacaggtaaaaaattctgttcattttttaaaactactaattttttcactcttgtatttgtaactcagtgacattttacctaactgcagagccaggtacctacagtacatcttcatgaacttgagcaacacaaat

SEQ ID NO: 13369 - DNA, 833 bp, Homo sapiens
  ENST00000484527
cttgaggaggatggagggctgggcggtggaggcggggcctgggggcgcgcggcggcggcggcgcggcggggggctgaggcgggccccagcggactcccgggcgccggtgctcggggctcggggctcggggcttgggcgtcgccggcgagcgcatgcccttccctgaagcgcggcctcttggcctggagctgggaccagttaggtaacggccccggggacccgcagtggagagtgagcggggctttcccccgggccagcccggcgcgctcgcccctggctgggcaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaaga

SEQ ID NO: 13370 - DNA, 592 bp, Homo sapiens
  ENST00000393618
atttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagatttgaagctgcttcaaataacaatctggtttataaaatgaaaatagaaaattatgatcttagaatgaagaagtgaat

SEQ ID NO: 13371 - DNA, 589 bp, Homo sapiens
  ENST00000441045
atttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagcacagacattgcatcatcttagcagctctttttcaaacagatttgaagctgcttcaaataacaatctggtttata

SEQ ID NO: 13372 - DNA, 1115 bp, Homo sapiens
  ENST00000486949
gagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgaggtaaattgtttttttaattcttatttaacattaattgaataaagaccattgaactgagattacagtttagaatttgttactaataaagctatataatctcctataatttacttaacctttccaggcttcaatttcctcatctataaaatgacagactaaataatctttaaggtttcttctagtagaatagaatgttctgagattttgtttaaatcaaattattgagagtgattgtttttaaaacctagttggctttcatctaattcattgccattttaagtgtgtattattttagagcaaacttagaaaaacagcacatttctagtaacttacgacattcgatgaatgataaatgttcaagttagactaaaggaactttattccaacttctagtaactactttcttcatttttctctcatcagtttaggtcttaggatctaccatctgttacttttcagtttctcatctaaataaaacaagatctgctgttcatattgtttaatttctcaggaagggtacattttgggctttgggtttatactgcgagccttttttttgtttttcttgtatgtatacctaagtagtcatatgttttcacatggtcagagttttgataataatactctacctagcttctgaacagtttaataatagatttaatccg

SEQ ID NO: 13373 - DNA, 581 bp, Homo sapiens
  ENST00000489358
tttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagtttaggtcttaggatctaccatctgttacttttcagtttctcatctaaataaaacaagatctgctgtt

SEQ ID NO: 13374 - DNA, 1147 bp, Homo sapiens
  ENST00000424768
tagtgttgactgaggttgtctttattagaagtctcagccatgcctccagtttcgagatgaatctcaattcacaagttccactatgaatctcaattcacaagttccactaccaccaccaccatcactgcccccagatagaatgagacttctaataacttgaaagacaagtctataaatatcctgtaatcgttttcactgtatcactttttcctggctacttttatccgataaaaacctcaatttatttttaagctattaaacatgcggacaaagggaatcttagttttatgcaaaaacgcaaccacgcatgagaactgcgcaagtctttcttggaatggtctgtatttgggtgaagtcatcagacgtcattacacttctttattttggggttgccaactcgtttcccaggatttaaagactataacgatgataaaagtcagtgtcgcaccctgtcaaaggcttggcccgttgccttttccttcccggcaatactcggttcaattaggtcttgtcccctcattatctgtgaggactgaattccacccccgcttttcaacgcaggctctttgctcgggaaaagtcaaaccatctctcaaaggatcaaagagctcagccatagacagagccgccggaggaaagcggagtcgctgcatcagatgaaaggggcccctcagcctcactcctcaccgcagctcctgggatcttaaagacagggtcaggaggatcaggagggacaagagggatggaggcgaaaggctggatccttaatccaggccggagacaaagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaa

SEQ ID NO: 13375 - DNA, 1976 bp, Homo sapiens
  ENST00000489732
tttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtattacttttcctagtatattttaaacactgcttattactcttaactcctttaggagttcttttagaatttttaacaaatctgttaatttggatgcattaaatcatataatttggtgtgtgtttgatgttctaagtatgagaaaagttttctgaaataaaaggtttttttttttttttggaaaccgagtttcgctcttgttggccaggctggagtgcaatggcatgatctcaactcagcgcaacctccgcctcctggtttcaggcaattctcctgcctctgcctcccgagtagatgggattacaggcatgcaccaccacacccaactaattttgtgtttttagtgaagacgggctttctccatgttggtcaggctggtcttgaactctcgacctcaggtgatccacctgtctcggcccaccaaagtgctgtgattacaggcgtgagccaccactcctggccgaactaaaagttttgaaataagtttagaaaagtcattaatttttggaggctaatcttgtttgttatactttagtcattaattcaaagtaaaggagttgttaatgaactggaaactccttttgaattatggtagcaatcagaatatttttatattagccagttttaccttgaagacctatttttaaaaactacctgtgtctctggacttagttgcaaatgcatattaaaacaaaaatcccccaatttctgtgctttcttatttgaaaggccatttctagggggaaaacagttcccaaacacattatacatgttggaaaagtttatctctaaccttttgaattaaacaatttcagaattgaaaacagtaaggtgaattttaggccaataactcttttctataatcttgactcttttaagattaggcagttcagatagtcttatactactgaaaacctagctagatatcagaagtaattattagtggcaagaataccaaagttaataccaaagtttttttgttttgttttgtttttagacagggtctcactcagtcacccaggctggagtgcagtggtgcaatcttggctcactgcaacctctgcctcccaggctccagagatccttcctgctcagcctctcaagtaactgggaccacaggctcgcaccaccatgcctggctacttttttatagtgacagggtctcaccatgttgaccaggctggtctcaaacttttgagctctcaagcgacccgcccgccttggcctcccaaaatgctgggattacagacatgagccaccacgcctggccccaagatactttaaacgagtttactagttatcttgtattaagttaccagcaactgatagcacactttaatttagtcatacaacttaagaactttgtaaaatattactcatttttaattataactaaaatgtattgattacctattctaggccagcattattgtaagtggttcgtatgtcttaactcattttgtcctcacaaacatcatataagtgggtactcgacttttatcctcatttacggataagaaaagttaattaaaagtgtgttgtttggggggcagacatttagtaattgtggaaattactgacttaccaaccctaaagatgccacattctttacgaacgaagtgagacgtttcatttggatgtaagaagcttttgagtcatctcaaagttgaaaagtaccaaaattaatcgagagaaa

SEQ ID NO: 13376 - DNA, 300 bp, Homo sapiens
  ENST00000417537
gtcaggaggatcaggagggacaagagggatggaggcgaaaggctggatccttaatccaggccggagacaaagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatg

SEQ ID NO: 13377 - DNA, 1839 bp, Homo sapiens
  ENST00000263354
tggagcgccgttcgccggtatgtgcgcatgcgttgaggtctcttgacgccgattggggggtcacgagtcacgggcggcgtgcggcggctggtgggggcgtgtccggcggagcgggcgcggcgttacgaggccgctggttggccagcgctagtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgcatga

SEQ ID NO: 13378 - DNA, 3898 bp, Homo sapiens
  ENST00000597778
tagccgttgcttctgggtccgccgattacaggatgtatgtgtcttcaaactgccggatttaggttgtgttctctccccttcctcctcatctgccccctttttgccaccgtttccactgtctgctgccacagtctcggtctgtcagccctagaacctggactgagtgctgtaccttctctcagtcccttttagatccccagaggtctttctgaattggacaaaacctacagaccccactccccagaggagtgcttatggaccccactgtttacatgtcagaaggaggggttggactccctgaaagcccagccacagacctgagacaaagagcctctgtccagatgcctccccacggagggagtttggagtcccatccagaccgtgagccccttgagaggagcccagccccggcgcttcttggtagcaccctcttctcaggcgaacatggcctgggtgaccatggagacccccacggtgaccaggaactttcagatgcccaggctgaagctcagagcccatgccctgtggcctgtccaagctccctgcctttccctctccccaacccaggcctccctccccacaacacccctgtcctcctgagatgtgctaaaatggtgttcttaaaaaataccccctgagagctcatttctgtctgctagaaaatgcctcccactcatgcttttctctctcctccaaataacttgtcaaaaaaaagcctttcccaaatttaaaatcttgcaagagatagtacaacaaaggtagcccagttcttcctcagtgccatcctggtgtgttcaggttttttggcaaaacctttgaggagctggtgggtggcaggactaggttaaagggactgagcagagggctcccgactgctgagctacgaggaagagggggcagtggagagcacactgagggctcagtgttgatgacatccagcctcctcgtgccagaggtccaggtcctcctggtgcaggagcagaagctgctcaggatcctgcagagatggtggcagagcccaggtagaacctggcaccctgttgcctccaagaccacctcagatgctggtttggccgcctcccatgcctccttcccctttgccagcagctcagtccttcaagagcagggccttggcaggtctgtcttaaaacaccgtgggagtctggccatcatcctggcctagcactgctgtgccctgtccctggggttgtgggaagctggtagcatcctggcagcccgaggagagaagggctcccccagaagcatgtgcccagcaagtcacagtctgcagagtcagccctctcaccagatttcctggggctcagggattccgtccccttcttcccagccccttgagagtgtgtggcagcgctggcagctctgagcgcctattgatctctctgctggcagccaggtgcgcctgcgtccgcctcctctcctcagcttctgctgaaacgacttcactttctcatgtctcctcccacctccctttctctccagaggccattaactgtttgatgcgagcaatcgagatctacacagacatgggccgattcacgattgcggccaagcaccacatctccattgctgagatctatgagacagagttggtggacatcgagaaggtgagtggcagcagggccctgcatgggctggcagccaggaccagtgctgctctctcttcttcccaccaggggagtcctctggtgtctgagtgccgagaagggggcatggggcgccggcagagcttggagaatggggtctggctgtgtcccaggcaggcagggcggagggtgtggaagcttcacggaggcctcctctcccttccctgccctcccctggaacccatcccccgtgtctccccaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggacaggtggggatggcggcttccaccctgccccctctcagggcctgtgcctcctcctaagccccggcaccttgttctggaaccacccctcccccggctcaccctctgcctctcccccgacatcccttgccatgtcatccccccaccctgtcttcagcctggctgaatgttctccacctacgactccatgccgtgccagcaccgtctctctccctggctgtgcccctcccacacccctcgcagagcttcctggaggggcccagagtgaggctggctaaagaacccagagggagggaatgggaagaagtgccaagaggcccagggtggccgtgggcaccccaccccatggcccgatggtcctcatccacagtgggagggagggagtgtcacatggggtccccccagcgtgcacggagccctgggtgatggccgagaaaaaggcaggcagctggccccctgggagagaggggcgggcgccgcctctcatgttcccaccgcctgccgccgctctgcccaccgccatgccagcctcccgttggtcctgacagccaggctgcctccttcccactgtctcaggctctcagaaggcccacgaacacctggctacagcctccacccccacccagccaccatcacaccctgatcttggtcgctcacgcactggccgctgacctctccaagctggtccctggctccctgcccttggggtcctgggttaacagggcctcacctcgggacatgaaccagctcccagctggccccccagtgcctggcagtggctctggccctctggctgcttgccctgagctcaccagtgccacttctccatggctacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgcatg

SEQ ID NO: 13379 - DNA, 554 bp, Homo sapiens
  ENST00000594217
cacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 13380 - DNA, 1467 bp, Homo sapiens
  ENST00000597271
ggagtttttttaccattgcctggcagaagcacggagtccaggatttcctggtgtccctggctcacggcctggggtggtggccccacacaccccacacacacacaccccacagagccctgccctgctgtgggcaccggtggtgggcaaaagcttgggctttgtcagaccaggttcccattcccaccccatgtctcaccgtgccctgggcaggtcactgcccctctctggatctgtttcctcactttgaaaagggggctcaccgtcatttgaccctctcagggtcctcaagaagcaccagccccaggcctggcatggaggatgtgctcatttgtcccctgccccagctgagccaggtgggaggaggcagtgggtgcctatctggggaaccttccccctccacccacctctccctgcagccatctctgcagccaggctggtgctgagctcagctacgggaaggtactgacagacacagagccaggtgacacctgaggctgggggaggggtgcaagagctgactcaatatcacccgacatccccaagtcccctcagctgctaggccagtagctctgaggaccctcttgttactaactcatcttctcccttccctgctgcccagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaa

SEQ ID NO: 13381 - DNA, 1460 bp, Homo sapiens
  ENST00000595227
tctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgca

SEQ ID NO: 13382 - DNA, 1417 bp, Homo sapiens
  ENST00000594001
ccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgc

SEQ ID NO: 13383 - DNA, 891 bp, Homo sapiens
  ENST00000593761
taccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtggtatgtcatctccgctagagctcctccaagctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagct

SEQ ID NO: 13384 - DNA, 548 bp, Homo sapiens
  ENST00000593905
acctctcgatcttcttcacacctcaggtcttcttcatacctcctcacaggcgtggctgaggggtgggaacttgaagggtcataggtcagcaggcaggcacgcaggaggtcatgagtcgcaggcagccccttcctgtgtcccctccagggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgct

SEQ ID NO: 13385 - DNA, 416 bp, Homo sapiens
  ENST00000594155
ctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaa

SEQ ID NO: 13386 - DNA, 989 bp, Homo sapiens
  ENST00000601208
cgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttgggccccatccagaccctactgagcgaatcccaaagtgtgtggctgtgggactctggtttgatgaaatgagcacttcatgtggctgaaagggatgggcaggttggacacactgaatccgcagtgcagagggaaggaatgctcacatcccagctcccaaaattacctttgagcccctccacagctggggttggtgtggacaagttcccagaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaa

SEQ ID NO: 13387 - DNA, 379 bp, Homo sapiens
  ENST00000598615
ggcgaattgcctggtgtggagaaacatccggggctgatggactggattgattagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttctt

SEQ ID NO: 13388 - DNA, 894 bp, Homo sapiens
  ENST00000602082
gatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggacaggtggggatggcggcttccaccctgccccctctcagggcctgtgcctcctcctaagccccggcaccttgttctggaaccacccctcccccggctcaccctctgcctctcccccgacatcccttgccatgtcatccccccaccctgtcttcagcctggctgaatgttctccacctacgactccatgccgtgccagcaccgtctctctccctggctgtgcccctcccacacccctcgcagagcttcctggaggggcccagagtgaggctggctaaagaacccagagggagggaatgggaagaagtgccaagaggcccagggtggccgtgggcaccccaccccatggcccgatggtcctcatccacagt

SEQ ID NO: 13389 - DNA, 643 bp, Homo sapiens
  ENST00000602174
ccgccatggacaattccgggaaggaagcggaggcgatggcgctgttggccgaggcggagcgcaaagtgaagaactcgcagtccttcttctctggcctctttggctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggacaggtggggatggcggcttccaccctgccccctctcagggcctgtgcctcctcctaagccccggcaccttgttctgg

SEQ ID NO: 13390 - DNA, 853 bp, Homo sapiens
  ENST00000595826
ccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttgggtgaataaatgtgtatgtgaatggcttcttcaggatcttccactggaacctaggcacgtcactttccccctttggggacttcactcccatttctaaaagaagaggatgggaccctggagatctcctgtcatcccctggccatgaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggacagg

SEQ ID NO: 13391 - DNA, 553 bp, Homo sapiens
  ENST00000597118
ggataatgtttagcaaaataacttgaagaacatgatggcgaattgcctggtgtggagaaacatccggggctgatggactggattgattagaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacag

SEQ ID NO: 13392 - DNA, 415 bp, Homo sapiens
  ENST00000596892
tgtcagaagctcgtccaggagccagctgtcccaggtgtctgctggtggcccgccgctttccagacatggaggggacttaaccccgtgagtccatgttgctgcctgggggaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggag

SEQ ID NO: 13393 - DNA, 562 bp, Homo sapiens
  ENST00000594288
gtttagcaaaataacttgaagaacatgatggcgaattgcctggtgtggagaaacatccggggctgatggactggattgattagaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtg

SEQ ID NO: 13394 - DNA, 857 bp, Homo sapiens
  ENST00000594740
gagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggtgagtggcagcagggccctgcatgggctggcagccaggaccagtgctgctctctcttcttcccaccaggggagtcctctggtgtctgagtgccgagaagggggcatggggcgccggcagagcttggagaatggggtctggctgtgtcccaggcaggcagggcggagggtgtggaagcttcacggaggcctcctctcccttccctgccctcccctggaacccatcccccgtgtctccccaggccattgcccactacgagcagtctgcagactactacaaaggcgaggagtccaacaggtagcccccttcctgcctgccccagccccgcagggaccgccaccactt

SEQ ID NO: 13395 - DNA, 583 bp, Homo sapiens
  ENST00000597274
agtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcaggga

SEQ ID NO: 13396 - DNA, 429 bp, Homo sapiens
  ENST00000601927
ccagcaagtcacagtctgcagagtcagccctctcaccagatttcctggggctcagggattccgtccccttcttcccagccccttgagagtgtgtggcagcgctggcagctctgagcgcctattgatctctctgctggcagccaggtgcgcctgcgtccgcctcctctcctcagcttctgctgaaacgacttcactttctcatgtctcctcccacctccctttctctccagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcct

SEQ ID NO: 13397 - DNA, 1536 bp, Homo sapiens
  ENST00000593785
gccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagtcccttttagatccccagaggtctttctgaattggacaaaacctacagaccccactccccagaggagtgcttatggaccccactgtttacatgtcagaaggaggggttggactccctgaaagcccagccacagacctgagacaaagagcctctgtccagatgcctccccacggagggagtttggagtcccatccagaccgtgagccccttgagaggagcccagccccggcgcttcttggtagcaccctcttctcaggcgaacatggcctgggtgaccatggagacccccacggtgaccaggaactttcagatgcccaggctgaagctcagagcccatgccctgtggcctgtccaagctccctgcctttccctctccccaacccaggcctccctccccacaacacccctgtcctcctgagatgtgctaaaatggtgttcttaaaaaataccccctgagagctcatttctgtctgctagaaaatgcctcccactcatgcttttctctctcctccaaataacttgtcaaaaaaaagcctttcccaaatttaaaatcttgcaagagatagtacaacaaaggtagcccagttcttcctcagtgccatcctggtgtgttcaggttttttggcaaaacctttgaggagctggtgggtggcaggactaggttaaagggactgagcagagggctcccgactgctgagctacgaggaagagggggcagtggagagcacactgagggctcagtgttgatgacatccagcctcctcgtgccagaggtccaggtcctcctggtgcaggagcagaagctgctcaggatcctgcagagatggtggcagagcccaggtagaacctggcaccctgttgcctccaagaccacctcagatgctggtttggccgcctcccatgcctccttcccctttgccagcagctcagtccttcaagagcagggccttggcaggtctgtcttaaaacaccgtgggagtctggccatcatcctggcctagcactgctgtgccctgtccctggggttgtgggaagctggtagcatcctggcagcccgaggagagaagggctcccccagaagcatgtgcccagcaagtcacagtctgcagagtcagccctctcaccagatttcctggggctca

SEQ ID NO: 13398 - DNA, 516 bp, Homo sapiens
  ENST00000597160
gccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggtcccttttagatccccagaggtctttctgaattggacaaaacctacagaccccactccccagaggagtgcttatggaccccactgtttacatgtcagaaggaggggttggactccctgaaagcccagccacagacctgagacaaagagcctctgtccagatgcctccccacggagggagtttggagtcccatccagaccgtgagccccttgagaggagcccagccccggcgcttcttggtagcaccctcttctcaggcgaacatggcctgggtgaccatggagacccccacggtgaccaggaactttcagatgcccagg

SEQ ID NO: 13399 - DNA, 2519 bp, Homo sapiens
  ENST00000281038
gtagcgtgatgacgtaagcggcgttggcgtggtgtggtaggagtggttgcgcgtgttgcggcccgggttctgttcgtaggtttacaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaaattttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagacacctatgg

SEQ ID NO: 13400 - DNA, 725 bp, Homo sapiens
  ENST00000529771
ggttgctgctgttgatcttctggttcctggagttggggaactctttggaggaggcctcagagaagaacgataccatttcttagaggagcgcttagccaggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatat

SEQ ID NO: 13401 - DNA, 2137 bp, Homo sapiens
  ENST00000528850
agggtctagctctgtcacccagactggagcgcagtgatgtgatctcagatgactacaacctccatctcccaggctcaagcaatcctcctgcctcggcctccagagtagctgaaactataggcatgcaccaccacactctataattttttaagttttttgtgaagatgagtctcactgtattgcccaggctggtctcaaactcctggactcaagcagtcctcctccttcggcatcccaaaatgctgggattacaggcataagcctggtagatgttgttataataaatacttattttttgagtaggttcttgctttgtcacccatgattgtactgacacagtcatggcttgccgttgcagtgatttctgttgtcctcacatatcctttactttttagcgggatggattcgttctgtccgatcccagaaggaagtcttgttcctgcatgtaaatgatgggtcatctttggaaagccttcaggttgttgcagattcaggccttgacagtagagaattaaattttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattt

SEQ ID NO: 13402 - DNA, 861 bp, Homo sapiens
  ENST00000525345
ccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcagggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttg

SEQ ID NO: 13403 - DNA, 755 bp, Homo sapiens
  ENST00000529880
gctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaaattttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaatggggtgctgacctacggactgaacatgaaaagtacctggtgaagcactgtggcaacatacctgtcttcgttattaattatccattaacactcaagcctttctacatgagggataatgaagatggccctca

SEQ ID NO: 13404 - DNA, 594 bp, Homo sapiens
  ENST00000529571
cttcttccccgtagcgtgatgacgtaagcggcgttggcgtggtgtgggatggattcgttctgtccgatcccagaaggaagtcttgttcctgcatgtaaatgatgggtcatctttggaaagccttcaggttgttgcagattcaggccttgacagtagagaattaaattttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcagg

SEQ ID NO: 13405 - DNA, 374 bp, Homo sapiens
  ENST00000526709
gaaatgttgtgcattattacgaaaacaaaagatagaataccaaagtgtgtatcctattgtgattggaacatataaaattaagtatgcatattggtgaactaaaagaagttgatttgttgaggcaggattgtgagtacatgttttactttcatttagtctgtgtgtgtatgtgtaatgaaaacgtaaaatgttttacgctcacattggaaatatttctcttccttagggatggattcgttctgtccgatcccagaaggaagtcttgttcctgcatgtaaatgatgggtcatctttggaaagccttcaggttgttgcagattcaggccttgacagtagagaattaaattttgggagttctgtggaagtacaagggc

SEQ ID NO: 13406 - DNA, 10667 bp, Homo sapiens
  ENST00000360655
tctcatgatgccggcagcagtcaccctcattgcaaaggcagtggtgccgagtgaggttcccgagtggattttaagaagacaggaagacctttgaagaggtggtgctgatttccttggctggcgggaactctgtctggctgttgcatgcatcacttttgtgtgggttattttgttcctctgtggatttggaagcatcgctgaaggagagagaggattttatttctgggaaatggaatcggtttctgagtccagccaacagcagaagagaaagccagttatccacggactggaagatcaaaagaggatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 13407 - DNA, 11000 bp, Homo sapiens
  ENST00000396085
gttaatatgggcgtccaagcctctgtttcccaggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtcaatgagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 13408 - DNA, 10960 bp, Homo sapiens
  ENST00000349880
aggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 13409 - DNA, 7882 bp, Homo sapiens
  ENST00000396087
taaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagtgcatcatccaaggactcatctcaaagcaaaatcatccgcttcactctgggtcagaaaaagatctctagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagaatcatgggagaaaagttctgtggacaactttgtcagccgtcttcacagctcacttcatttctctcttcctttgttccatcacgcaaggtatgagttagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtcaatgagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaa

SEQ ID NO: 13410 - DNA, 684 bp, Homo sapiens
  ENST00000534229
tctcttggattgcacacgctgggattgtctcctacgagcatgtctgcgccctcacagcctgtcccgggacagcgtggtccgcgtcccccgagcccccattgtgtcttgatactttggggtgcacatggctattgatctctactgcggtttggcttgtctgtggggaatacatgagccccgaatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccag

SEQ ID NO: 13411 - DNA, 570 bp, Homo sapiens
  ENST00000528008
ttgcaggagaaagtggctgctgctagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaaca

SEQ ID NO: 13412 - DNA, 5084 bp, Homo sapiens
  ENST00000533917
aatcttttcaatcgaatgctttgccttcagacgtcaatggaatgagctaagaaatgttatagtcaatgatttttgcatcattaaaagtagcacttagggctggaaagactttctgcaatgtttctgtgcagtctgtgaggatttaaagtagtttttcattcttagattttcttcaatttgacccgctgttgcaaactcccctgggaccacatggagggcccttccattcagtgctttacgggccgcaatgtagtgaaatgctctggcctaggaaccttacaagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaa

SEQ ID NO: 13413 - DNA, 2716 bp, Homo sapiens
  ENST00000525322
acttttcacagctgacttgataccagcactgaggcctgacctctcgatccttcagcacttcagaggttaattttgttgggggatcggatttctttcctggcctggggaatggtgatccctgctagctagtcctttagttacagagttgctgggtgcctgggattccctggcccagtgtgggctggctcagctggctaaaggacttgccatcctgtgagattcattcagcttctttgtccgctgttctccaagggccgcaatgtagtgaaatgctctggcctaggaaccttacaagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactc

SEQ ID NO: 13414 - DNA, 556 bp, Homo sapiens
  ENST00000530408
acagctgacttgataccagcactgaggcctgacctctcgatccttcagcacttcagagggccgcaatgtagtgaaatgctctggcctaggaaccttacaagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgt

SEQ ID NO: 13415 - DNA, 668 bp, Homo sapiens
  ENST00000534299
agttaggcttgctcactcatccacaccaaaggatctcgttccgctcgggccccggggtttcacgggaacaattgccttgaacaatagccagaaaacgagttccaccagtctggacttttttgcaactgaatgcagctgtctggcggggggcatgggccagccctgtaaatgggctgtgccttgattctggagcagaactggaaaattgagcagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgt

SEQ ID NO: 13416 - DNA, 607 bp, Homo sapiens
  ENST00000526675
agactgtttccaaggacagtaagggcctcctggaagcagacccagcctttggagtttggggaggattaggatccttgctttgtgaagactgcttttcagaaccgtagttagagaacctcatctctgctcaccggctgtggttttattactgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctga

SEQ ID NO: 13417 - DNA, 2289 bp, Homo sapiens
  ENST00000533746
cccgctgccatagcaccacgctggtgctctctcatggccaggatgtgggaggggctgttcacctcggttgtgctagattgcattgctgcctgattgacatcaccaaacaccccttgccccatattgaatctcagttgactccacctctcctgcctgggcccttagaggtggatgtgaaggtgtctcctgggctaggacccccggctcatttccactggccattctatgggcatctctgagggagatctattgaaagtgggtctgtatgtaattaccagagaaatgttgactcctccagcacactgagagcatggctcacctctgcatttaggctgtcctggtcttgttcatgctttcccctaattatccctcaagtccatcgtcctcctctttccccctatcactgccccatcatcacccagcacaccattgccatcacctagctggtacgtctgcttgcagctttccccctgcactctgtagccaatcctctgcactgtggcagccagaccagagtgagcattctagagtacacatctgaccatagaactctcgtgcttaaagtccttcagtagctccagctccctatggcctgcaggatgaaatccagactccgttggttggcaggtcaagtatgaacttcagctacactaaacctctggtagtttccccaaacatccatgctatttcccatgcctttgcaaaggctgcagcatcaccccactcctgaccccaacaactgctcctgcctttccttatgttgctgcccattatctgtccagtctcagcccagacatcccctcctctaaggagccttccctgattcccttaggcttcatcatatttcatttctttctttgcctgtctgcctcctccaccagactgtgagctcctgggaaccaggacggtgtcttagtcatagtgatagttccatagcctagcaccgggcctgacatcaagcacaagaggcagtttgtctcagtggttagagcctagcctctggagccaggcttcttggttctcatcttagctcttcaattaactagctgtttgatcctggaaaagttacatgacctgtctgttcctcagcatttctgtccgtaaaacggaggtggagataatatctatgttagagggttggtatcaggaactgtgagttaatacatagttacaatgtttagaagagtgttcggtgcatagctaatccaatttgttgcattagcatatacaccttctgtttctaacgtgctttggttcctgaggtcagccatcatttggatcaccatcatcagcttgaaaagtgtttctgacttcctccagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagac

SEQ ID NO: 13418 - DNA, 627 bp, Homo sapiens
  ENST00000525025
tttttttttttttttgtatttttagtagatacggtgtttcaccgtgttagccaggatggtctcgatctcctgaccttgtgatccacccgcctcagcctcccaaagtgctgggattataggcgtgagccactgcgcatgggcttccatttttaaaaatcaagattagtgatgccacagtgagcatcttccccataaagcctttcctggaggagggagacccccaggtggaatcagggatcagagtgtccttctctgtggccaccatccagggctagtatacctgcgttcaggcctcagccctgccatccctcagaacgtctagggtccctcctgtgaagggtgctcggaccatggcttcacctgatgccccatcacccatgcccatttgagtgctaatgtattttcactgtggtctccaggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtg

SEQ ID NO: 13419 - DNA, 563 bp, Homo sapiens
  ENST00000528923
tctagaccactgggtcatgctgccttcagccttagcacctcgaactgtctgcatcttggatgacttcctgagcatggaatagaagtggaattactccatcagggaaggcatgatgctggatttggggagtttttcagaaagctgcaaaactggggctacgagagagatctgggccacttccagactgttccttctttgcctgttttcagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccct

SEQ ID NO: 13420 - DNA, 11003 bp, Homo sapiens
  ENST00000540292
gttaatatgggcgtccaagcctctgtttcccaggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtgaatattcagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 13421 - DNA, 11171 bp, Homo sapiens
  ENST00000527559
gttaatatgggcgtccaagcctctgtttcccaggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagtgcatcatccaaggactcatctcaaagcaaaatcatccgcttcactctgggtcagaaaaagatctctagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagaatcatgggagaaaagttctgtggacaactttgtcagccgtcttcacagctcacttcatttctctcttcctttgttccatcacgcaaggtatgagttagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtgaatattcagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 13422 - DNA, 3283 bp, Homo sapiens
  ENST00000220931
gtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacaga

SEQ ID NO: 13423 - DNA, 2289 bp, Homo sapiens
  ENST00000521599
gggggaggcgggcggagggaaggcgctgccgctgctgccgccgcctcgcccgaagcgacacagacgctgggagcggccgaggcgagatcctatcattattttaaaattcctcctcctccacgaagtccttcctgattccttcaaagaaatatcactcctccgaattcccagagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttga

SEQ ID NO: 13424 - DNA, 1805 bp, Homo sapiens
  ENST00000519508
ctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaaca

SEQ ID NO: 13425 - DNA, 1315 bp, Homo sapiens
  ENST00000522951
acacagtcaaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacgcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttag

SEQ ID NO: 13426 - DNA, 2528 bp, Homo sapiens
  ENST00000522754
tgttaggaacttctggcagggttggtcctgagcaagactgtaaagcagctcaggtgaagcttcagtgtctttttctgctctcacctttcccatttggaggcgactcccctcagctgctttcctttctctgtcctctgcacctgccttgctgcccctagagctccagaactctctgaaattttctgcctactccctggcaaaatctattttttctaaaaattgtccccagggccaagatgcccaaagtgactctgattagcaaagtcatgatctggggataaaaacaatgacttttcattcctcttcccaaataaaaactacctttgaccacagaggtcaaagggcccttactgagtcccatgtggaggtcacaggcatggggtgatagtttcagtagtgcttacaaaactccacagaatcctctttcgcccatcagatctcatagctgtacccagtttagctcaggcctgaggatgcataataattcagagctctgatggcaggtggtttccatctcaggactgcctggaagcttgctgagaaggaacttgagaccattgtcacacacagggagaaaagcactggaatggactagaagtctgcctggggaaacatgtggcatgcacttacagagtgttacatgtctgtcatccttgaggagtcattgtggactctcaagggtccatgataggcatccacttgcctctctagcctgaagaatgtcatctgcagccttgctcctcaaagtgggaaccttgcttttcaaagcagcgtcttcagaacagcagcatcagcatcacaccggagcttattaaaaatacagactctcagccccacccctttcccccacactacccaatcagattctgcattttaacaagattcccaggggatttgtatgcacataaacaatggagacggctaggagaggtggcgcatgtctgtaatcccagcactttgggaggctgagggaggagaagcttgagcccaggagttcgagaccagcttgggcaacataatgagaccttgtctgtacagaaaaaaaaaaaaaaaaaaaaaaaaaaaaaaaaacgccctgtgtggtggggagtacctctagtcccagctgctgctcaggagactgaggtgggaggattgcttgagcctatgaaatggagcctgcagtgagccgtaagcgtgccactacactccagcctgggtgacagaatgagaccctgtctcaaaaaacaatcaaaaaacattggagacacaggggtctactgggtcttcctgctggttgtccctcctgaaggtcctcactggaggagaacaagctttgtgggcccggcttcttctacctgtgcctccacatcttataccaatcaataggggtaggactaggtccaatgcggatggggacattcccttcagcccgcatttgggaggtttaatgataggtctattgtgtgccatactgtttttctgtcttaccaccatgtcgcttctgtccccaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccag

SEQ ID NO: 13427 - DNA, 583 bp, Homo sapiens
  ENST00000522448
aaaggcttgtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggagaggaaaaagatggctcagctattttttcacaggtttacactagttgagctaatatgcgtgtctttggaaattaaa

SEQ ID NO: 13428 - DNA, 548 bp, Homo sapiens
  ENST00000520690
acacactgaagtttgagaagcactgcctttgcagctatggcaaacttctggaacacgaagaaataaagctattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatga

SEQ ID NO: 13429 - DNA, 574 bp, Homo sapiens
  ENST00000518727
tgactttgcaagatggctgactgaacaaaagacacagaaatgcctggtcctgctaattcctgagccatttggggattatgcaacgtaaatctggttgcttcttggctttccggctaccgccttaggattcatattttcagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgct

SEQ ID NO: 13430 - DNA, 580 bp, Homo sapiens
  ENST00000520425
agatgacagctgcaagtgttgagtgctgtacgagtttaaatggagagcgggattgctggcagctgcggtgggcagggattttctcctttttaaaattgagatcaggtttgaacatgactttgcaagatggctgactgaacaaaagacacagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagag

SEQ ID NO: 13431 - DNA, 570 bp, Homo sapiens
  ENST00000518166
gacggtgctgtccagggggaggcgggcggagggaaggcgctgccgctgctgccgccgcctcgcccgaagcgacacagacgctgggagcggccgaggcgagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcag

SEQ ID NO: 13432 - DNA, 562 bp, Homo sapiens
  ENST00000522252
acacagtcaaaggcttgtgagaatctggtggatgctggaccttgctgctgctgctactgctgtttccaggggctgcagagcatggactgttaaatcttgcacttcttctgagtgagggagaaaagggaatttttaaaaggagaatgaaagtgtccttgtctctagaactgaagcaacttggaggaatgagtggagtctttgtttagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaa

SEQ ID NO: 13433 - DNA, 583 bp, Homo sapiens
  ENST00000517822
acacagacgctgggagcggccgaggcgagtgatttcttctgacttgagcctgcagtgtgctgtgagagatctaccactagattatctcaactttggtctcctgggaccactcgttgctgacagtcagaaactgctctatgaatggacgctgccccagtacagcgaggacctgctgcaaaatgcatttcttagtcttcaatacttattcctccttgtaactggatttctgctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacgg

SEQ ID NO: 13434 - DNA, 553 bp, Homo sapiens
  ENST00000524209
acagacgctgggagcggccgaggcgagtgatttcttctgacttgagcctgcagtgtgctgtgagagatctaccactagattatctcaactttggtctcctgggaccactcgttgctgacagtcagaaaggagaaaagggaatttttaaaaggagaatgaaagtgtccttgtctctagaactgaagcaacttggaggaatgagtggagtctttgtttagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttca

SEQ ID NO: 13435 - DNA, 629 bp, Homo sapiens
  ENST00000517531
actttgcagagggccgcgcagaggcgcgtggggccggcgggatggggcgcgctgggcagaagggggcgttggtgagcctggcggcccggggacctctggagcatcccgccccgggggccggggccggggccgggggccggggcacccgctggatcccgggcctgcggagtctgcccggaaaggccacaggagagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttc

SEQ ID NO: 13436 - DNA, 565 bp, Homo sapiens
  ENST00000521964
ggtgctgtccagggggaggcgggcggagggaaggcgctgccgctgctgccgccgcctcgcccgaagcgacacagacgctgggagcggccgaggcgagtgatttcttctgacttgagcctgcagtgtgctgtgagagatctaccactagattatctcaactttggtctcctgggaccactcgttgctgacagtcagaaattgcaaggcatctgatctcctggtgttaaaatctgtcgtgataccgaggaaggccccgagatcccaggcactgagtgactgcatactctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatc

SEQ ID NO: 13437 - DNA, 538 bp, Homo sapiens
  ENST00000519098
acacagtcaaaggcttgtgagaatctggtggatgctggaccttgctgctgctgctactgctgtttccaggggctgcagagcatggactgttaaatcttgcacttcttctgagtgagaagaaaaagaactctgaaatgaaattgaggatttgaacttcacacagctgtttgaaggagaaaagggaatttttaaaaggagaatgaaagtgtccttgtctctagaactgaagcaacttggaggaatgagtggagtctttgtttagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcat

SEQ ID NO: 13438 - DNA, 549 bp, Homo sapiens
  ENST00000523923
gacacagacgctgggagcggccgaggcgagtgatttcttctgacttgagcctgcagtgtgctgtgagagatctaccactagattatctcaactttggtctcctgggaccactcgttgctgacagtcagaaactgctctatgaatggacgctgccccagtacagcgaggacctgctgcaaaatgcatttcttagtcttcaatacttattcctccttgtaactggatttctgaagaaaaagaactctgaaatgaaattgaggatttgaacttcacacagctgtttgaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagact

SEQ ID NO: 13439 - DNA, 488 bp, Homo sapiens
  ENST00000520346
agaatctggtggatgctggaccttgctgctgctgctactgctgtttccaggggctgcagagcatggactgttaaatcttgcacttcttctgagtgaggaagacgaagcaaccccagtggagactctgcctcaagggcctgactgtgtagcaggagggagacagaaacaaaccccagaatgcgtgaaatcgcaaagaagattggcaatcattaaaatggggatatgctgtctttcagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgg

SEQ ID NO: 13440 - DNA, 548 bp, Homo sapiens
  ENST00000518661
aatttgtattttatgtatattaacagatctataaatacatctattagatgtatttagactttttaattattcttcctagttcctgataagctaagacaatacttttatttttgacagagtgatttcttctgacttgagcctgcagtgtgctgtgagagatctaccactagattatctcaactttggtctcctgggaccactcgttgctgacagtcagaaattgcaaggcatctgatctcctggtgttaaaatctgtcgtgataccgaggaaggccccgagatcccaggcactgagtgactgcatactctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgca

SEQ ID NO: 13441 - DNA, 585 bp, Homo sapiens
  ENST00000522206
aaaagcagcccccctcccaccttgtgggcatgaagagtccagaggacaccacctgagaagcttttcaactgccttccaaggctcccttgaacttcactgcggtagagcagggaccccagaccccccctcaaatcgaagcttggaaggaggtgctctaggctgaatctgacctcccaggacccgaggagagtctggctctctcacccacgctggagtgcagtggtgccatattggctcactgcagcctccatctcctgggttcaagcaattctggtgcctcagcctcctgagtagctgggattacagagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatg

SEQ ID NO: 13442 - DNA, 552 bp, Homo sapiens
  ENST00000524137
ataattcagcgttgatggcaaaatctcaatgatgaagtttatcactaaaagaaaacaacctatgctgtgaaagcagagatgctctagaatctacaggtcttttcctatgggaaaataagagaaaaaaagactgtcatcagaatcattttacagcattgagactatgttgatttcaaggtcatgtttgttgcagcttcaaaagatgctggcaaggaacgagaagaaaaagaactctgaaatgaaattgaggatttgaacttcacacagctgtttgaaggagaaaagggaatttttaaaaggagaatgaaagtgtccttgtctctagaactgaagcaacttggaggaatgagtggagtctttgtttagtgagtgagttctcatgagatctgatggttttgtaaggggcttttaccccttttgctcagcacttctccttcctgccatcatgtgaagaagggcatgtttgcttccccttctaccatgattctgaattcttgccgccaggatggggaaacagaacagcaagctgcgcccggaggtcatgcaggactt

SEQ ID NO: 13443 - DNA, 540 bp, Homo sapiens
  ENST00000522078
acagtttacagaaggctttgggtagagaaagcactagttagacaaaagcagcccccctcccaccttgtgggcatgaagagtccagaggacaccacctgagaagcttttcaactgccttccaaggctcccttgaacttcactgcggtagagcagggaccccagaccccccctcaaatcgaagcttggaaggaggtgctctaggctgaatctgacctcccaggacccgaggaggcaagcagatggcaccccttggaaagtagcagtgcaggctggctagaggcctgggcgagtgatttcttctgacttgagcctgcagtgtgctgtgagagatctaccactagattatctcaactttggtctcctgggaccactcgttgctgacagtcagaaattgcaaggcatctgatctcctggtgttaaaatctgtcgtgataccgaggaaggccccgagatcccaggcactgagtgactgcatactctgaattcttgccgccaggatggggaaacagaacagcaagctgcgcccggaggtcatgcagg

SEQ ID NO: 13444 - DNA, 543 bp, Homo sapiens
  ENST00000523645
gatgctggaccttgctgctgctgctactgctgtttccaggggctgcagagcatggactgttaaatcttgcacttcttctgagtgagaagaaaaagaactctgaaatgaaattgaggatttgaacttcacacagctgtttgaaggagaaaagggaatttttaaaaggagaatgaaagtgtccttgtctctagaactgaagcaacttggaggaatgagtggagtctttgtttagtgagtgagttctcatgagatctgatggttttgtaaggggcttttaccccttttgctcagcacttctccttcctgccatcatgtgaagaagggcatgtttgcttccccttctaccatgattctctctttctttaaatgagatatggtggtgcgtaatgatcgaagcagagacttggagtctggtgtgcctgtattcaaatctgactgcaccacttactgtctgccagatcttggataaattatttaatctccctaaacctcagtgtcctcatctgtgaagtgagctgaattcttgccgccaggatggggaaa

SEQ ID NO: 13445 - DNA, 543 bp, Homo sapiens
  ENST00000518952
acagacgctgggagcggccgaggcgagtgatttcttctgacttgagcctgcagtgtgctgtgagagatctaccactagattatctcaactttggtctcctgggaccactcgttgctgacagtcagaaaggagaaaagggaatttttaaaaggagaatgaaagtgtccttgtctctagaactgaagcaacttggaggaatgagtggagtctttgtttagtgagtgagttctcatgagatctgatggttttgtaaggggcttttaccccttttgctcagcacttctccttcctgccatcatgtgaagaagggcatgtttgcttccccttctaccatgattgtaagtttcctgaggcctccccagccatgctgaactctctctttctttaaatgagatatggtggtgcgtaatgatcgaagcagagacttggagtctggtgtgcctgtattcaaatctgactgcaccacttactgtctgccagatcttggataaattatttaatctccctaaacctcagtgtcctcatctgtgaagtgaggtgagt

SEQ ID NO: 13446 - DNA, 372 bp, Homo sapiens
  ENST00000521957
acacagtcaaaggcttgtgagaatctggtggatgctggaccttgctgctgctgctactgctgtttccaggggctgcagagcatggactgttaaatcttgcacttcttctgagtgagccacactggccactgcagtccaaaagagaattctaaaaggaaacagtacaaaacagaacatcaaaacaaaacagacaaacaacctgggaaccattaggttttacaccagagtgaaaccccagaagagacattctgcagctggtgaacagccggcctcatttgtgagcaatctgttcccatcagtgtcagggattccagaagaaaaagaactctgaaatgaaattgaggatttgaacttcacacagctgtttgaagt

SEQ ID NO: 13447 - DNA, 556 bp, Homo sapiens
  ENST00000521371
aaaggcttgtgagaatctggtggatgctggaccttgctgctgctgctactgctgtttccaggggctgcagagcatggactgttaaatcttgcacttcttctgagtgagactatatttcagcggtatgaaatacaagagaataattcagcgttgatggcaaaatctcaatgatgaagtttatcactaaaagaaaacaacctatgctgtgaaagcagagatgctctagaatctacaggtcttttcctatgggaaaataagagaaaaaaagactgtcatcagaatcattttacagcattgagactatgttgatttcaaggtcatgtttgttgcagcttcaaaagatgctggcaaggaacgagccacactggccactgcagtccaaaagagaattctaaaaggaaacagtacaaaacagaacatcaaaacaaaacagacaaacaacctgggaaccattaggttttacaccagagtgaaaccccagaagagacattctgcagctggtgaacagccggcctcatttgtgagcaatctgttcccatcagtgtcagggattcca

SEQ ID NO: 13448 - DNA, 469 bp, Homo sapiens
  ENST00000524101
gctgctgctgctactgctgtttccaggggctgcagagcatggactgttaaatcttgcacttcttctgagtgagactatatttcagcggtatgaaatacaagagaataattcagcgttgatggcaaaatctcaatgatgaagtttatcactaaaagaaaacaacctatgctgtgaaagcagagatgctctagaatctacaggtcttttcctatgggaaaataagagaaaaaaagactgtcatcagaatcattttacagcattgagactatgttgatttcaaggtcatgtttgttgcagcttcaaaagatgctggcaaggaacgaggtactctagaaacctggctgttgcattattaaatattttgtgtatagtttcggacattcttaacccgtttggtgctgtggacctctttggcagcctggtgaagcctatgtacttttctcagaattatgtttttacatgcataaaa

SEQ ID NO: 13449 - DNA, 425 bp, Homo sapiens
  ENST00000517639
acagacgctgggagcggccgaggcgagtgatttcttctgacttgagcctgcagtgtgctgtgagagatctaccactagattatctcaactttggtctcctgggaccactcgttgctgacagtcagaaagtaagtgtatatttaaaatgttcttcttagctataaatggaaatctcagttttgttcagtagttttcacaagagacagttctgttcaaatgttttatcaagaatagtagcataatgaatgggagttttgtatatataaaagatactaaagcccatttaaaaaatttatggaaatgataaataaatagaaatgaagtaaataaggtactgcctgcttatcacctttgaatattacttacagcataataaagtatatttgcaaccactcagtggagtagtttttatatgacatcttcat

SEQ ID NO: 13450 - DNA, 3808 bp, Homo sapiens
  ENST00000395923
aggggccccttagatgtcttcctccggattttttgttaagcttttcctagacagtttacagaaggctttgggtagagaaagcactagttagacaaaagcagcccccctcccaccttgtgggcatgaagagtccagaggacaccacctgagaagcttttcaactgccttccaaggctcccttgaacttcactgcggtagagcagggaccccagaccccccctcaaatcgaagcttggaaggaggtgctctaggctgaatctgacctcccaggacccgaggaggcaagcagatggcaccccttggaaagtagcagtgcaggctggctagaggcctgggcgagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatg

SEQ ID NO: 13451 - DNA, 3655 bp, Homo sapiens
  ENST00000311028
gacggtgctgtccagggggaggcgggcggagggaaggcgctgccgctgctgccgccgcctcgcccgaagcgacacagacgctgggagcggccgaggcgagtgatttcttctgacttgagcctgcagtgtgctgtgagagatctaccactagattatctcaactttggtctcctgggaccactcgttgctgacagtcagaaattgcaaggcatctgatctcctggtgttaaaatctgtcgtgataccgaggaaggccccgagatcccaggcactgagtgactgcatactctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatg

SEQ ID NO: 13452 - DNA, 8135 bp, Homo sapiens
  ENST00000400546
gctgccgccgcggcggccgctgctgctgctgcttctgccgccgctgccgccgccgctgcctggatatagtgcggcaagagcggagcttgcagtcactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcgggaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgttcatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtgacatttctgtttctctcatttattcggattttccttgtaaagaaattgacatatatttcatatatatatacacatatatatatatacacatatatatacatatatatatatgatgttaaatttcctgccactcatgtggagtaatgatctgaaattaacagataatctgaagctaattatattcagactatttcaagtgcactgtttcagttgcccgggtggtccttacctcttgtccttgaaatccatgccatgctgaagcaaggcaatactgtgataaagtattttttttaatatttcaatggaatgctccaaatgatttataaaaatttcaaaataaaagatggcttgtagtaaattgtaaaatatgagtagaactgaaataacctgtttcattcttattctagattaaacaaacatatacatataaccatataaatgttatttttattgtctgagagtactcttaaatattagtataaagtgtcaaaagaattgactgaatataagtactgttaaaataatttgaaccctatgatattttaaaccaagaggcaaagatatcacctaaaacttggtatttcttgataggttaggtgcaattaggcagtgacaatctgtattcaacaacatataagaggaaagagtaatatcagaattttgacacaaattaatgtgtcaacatattttacaatgattgtcaaaggaatttaagaattgtatttttaaagatttatttattatttttgtgggctaagacattgccattctattgatactaatgtctaacattaatgtttcttgttttcttttatttttaatattaataactataaaagcatttttcaaaggctatttgatccagcacacttcatatggatcttagtctttgaattaaatatttatataaatagattttattaatcaaattatttatttgtgtgccaacaattaattgtaactttatgatcatatctttgtttatgcttcttattttaaataattaagatgtatctgtgccttttaattagcatgacagtctgctttattaaaagaaaaaaactacaattaacatcattactagtatattttgcttagatttgagatactcaaatgatgctgtcttatttacagtcagtaattaagttcaattcaaactattttaccttgaatataaaatctaaatataataaactatactgtataatttactttaattcatgtcaaaacaattctttttatacacacacatgaaatattcttaatctgttctgtattgtttttctaaacaataaatacattctagatattgttgaaattaaattttgccagttgtaagacaaagacaacagataacttttgaaaatcaagcaaattactatggtgtttcttgggtcttcattattccatttatatatattttttatttcgaataataaatcaacctttatttttggcaataagattatcactgacgaaaatatgtacagttcaagaagtagaaataatattttccattagttaatttaggaaatattggaatagcatattataattatttatgaggttcccaatgttgtttttcacagaaaataaggtaaacattcaacttaaatcccccatgaagttttttcatgctcatactcataatcattatcacataatgtgcttattcaacaaactttgtatctggatatatttttaacaataagtttgttagcattatttatttatctttagagagaaaatatttgcatctgtttatttaccctttgaagcattaatacttagtcactcacattgaaattgcatatggatgtatcaacataggctaaaattaaattatggatgtcgcagaaatgaaatacttcatcttagaaggtaaaattttcaagaaagtattttattcatggacttaataatgtcttaagatgaaacaattttatgtccaaatgagaaatttataaaaagacccacatatagtagttgctgaacaaacataattttcttccagctcccatccttcctttttgaaaaattgaatttacccatgtagatgcagctatttacaattatacaagaatgcgaatagattaattatatcttctcatataaaggcaaagaattttatattatatataatgctaaatatttatttgataacacaatattcttagaaaaatagtttattactttaggattttatctataacataaatatattatttgttattacctctttaaattttcattttatacaatttttgagattctggccacacaacattcagaattattgctcatgtaaatttaaatattgctacttattttttttcttttctgaaatgaaaacatgaatcttttggcatctgtttttagcctcccatggaagacagtaagcaaaaccatcactgttggagaatttcaaatcacaacccgacataggagagtagagaaacaaagaaatgagtggatctagaaaggcaaactgaattgctatatttggaatagctaagaaggacctgactttgagaagtgctagaccagggactaggaacgttgcttagataaaaattatggccgattacactgatgcgaaggagaaaacagtgtaacacagaggagaaagttaacagagatagaatctatgatttaattttgcaaatagtttttttagagaacaacatgcatactataaaagaaatgatactattaagaacaaacctacttgttccaactcttaaagaaatattcatggtttagcatttgcctctaaaccctgttagaaatatgtgaagttagaaataaaggtttttttaaaaaaaaagcttttttggtatgtgaactgtatgctgtgctcagtatgtactgaaacatactatcttttattttctttaatttatatattccattcaaattctatattcttaagttagctaccacaacgttttcttattgtttcaatatggtatgtcccaatgaaatgctgtatatatatgtctaaactgtaaaaattatactgcaaatgttgaagttttgtatttatgagagacattgaaagtatggcttacagtatatcaaacttgtcacacttcaccatttgtatattaatagtaaagatacttttactttaa

SEQ ID NO: 13453 - DNA, 583 bp, Homo sapiens
  ENST00000486367
aaagggaaaatatgtggcggatgcaggagacaggatgcaagcagtctgatgcccatcatctatatataggctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagag

SEQ ID NO: 13454 - DNA, 582 bp, Homo sapiens
  ENST00000461281
atattcctttggcaactagttccatgtaaaggcatgtgaagacagaactggagaatgccaggtgataaatttcagatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattc

SEQ ID NO: 13455 - DNA, 340 bp, Homo sapiens
  ENST00000484983
gcaaaactcctcatagcgcctgtgaaatgttgaaggaaggggattgctgacaatacaagccagaaagagcttttgcctgaaatactcagataattcaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagt

SEQ ID NO: 13456 - DNA, 4699 bp, Homo sapiens
  ENST00000284894
agctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcgggaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgttcatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtg

SEQ ID NO: 13457 - DNA, 6387 bp, Homo sapiens
  ENST00000252575
ggggctggacccggcgcggagctggctgagtcggagcgcagcgtcctttgtgcccggcggccgccccgggatgcgtccgagctaggagccagatccaggatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaa

SEQ ID NO: 13458 - DNA, 2361 bp, Homo sapiens
  ENST00000590187
ctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagtaggggctctggggagggggccacctgcctggagggtgggcaggggtggcacttgtagcccttttgccagggcatcgcatccctcccctggttttcaagacgtcatctttccaaagctgtgttcattaacgcaagccctgactgcttcttaatgcatgaaatctgtcaattcacttgttaattcatacattcacttcattcattcattcaccaaatatttactgagcacctgctatatgccaggcaccattccaggaatattgacacagcacagcagcaatcaaggctgactttgctttgtccccagggagtgaccatttcttggggaggatatagacaaacaagtaaatatctaagtaaataagtctatactgtaattc

SEQ ID NO: 13459 - DNA, 545 bp, Homo sapiens
  ENST00000588231
agggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaa

SEQ ID NO: 13460 - DNA, 568 bp, Homo sapiens
  ENST00000585410
ggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacgtaagtagcttctcccagagatctcaacataggtttttggtatttctagtttccaagtaagacatcctatttctccacacattgatctggcttaatgtctgcctgataatacagccttgcagataagtgagaactta

SEQ ID NO: 13461 - DNA, 4687 bp, Homo sapiens
  ENST00000475381
agagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttcattttcccgtctcattttctgtttcccatttgaaaacagtgttctcttctcttctttctgtatgccaaattgccagccacaattctttcccaatcttctgcccagtggagtactccagctgtctttcctttagagaggtggttcagtggcctccttgatgacatttgtttcatgtctggatacagtatgtgttgccctcctttggactggctagaatattcataaaagccaggcaggccctgggactattttgggaccttcaatacacatgttaggaaaaggatgatcataatgccaagagtttgagctgaattgtttcagccaaagcatcactatcactgaaggcaggttctcaaactgaccttgtcattacaaataaatctaatttcacacttga

SEQ ID NO: 13462 - DNA, 587 bp, Homo sapiens
  ENST00000470419
ctatttccagatttaaaagaaccagtttccatctaaactttaaatgtcccccaaaattggagaaggccttaaatgaatacaacttttgtttttacagatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaat

SEQ ID NO: 13463 - DNA, 921 bp, Homo sapiens
  ENST00000424772
ccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaagtgcgtcctggtcaccttcagatgaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtgg

SEQ ID NO: 13464 - DNA, 602 bp, Homo sapiens
  ENST00000421723
gattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatc

SEQ ID NO: 13465 - DNA, 4315 bp, Homo sapiens
  ENST00000538775
agagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaagtgcgtcctggtcaccttcagatgaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttca

SEQ ID NO: 13466 - DNA, 4062 bp, Homo sapiens
  ENST00000543711
agagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttca

SEQ ID NO: 13467 - DNA, 1959 bp, Homo sapiens
  ENST00000640590
aatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttgca

SEQ ID NO: 13468 - DNA, 7594 bp, Homo sapiens
  ENST00000409261
gcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaaggcaatcatcacaaaactgggataaaaggctaagtattgattcttcgctcccaagtggctttgctagtcctacaaatgaactacctccaactcgtatcaaggaaagccacattttggaagggctaagaaagctacagaagcgaaaagtgttacttgaacccccatcagtgataaccaaatggggttataaagattgcatgaactcgaatgaaggaatatattctcctggaattaaaagtagcagcctcaaggagtatcccccctgcaaaacagctgacctggggagcccctgcaaggaaccccacaagacatttgtttatgatctagattcccacgttgatgcggacgatgacccttccaccttagcattgctccaagcagttccaaaccagagctgcaggccacatggcagtaaattaacccacagtgtttccgacagtctgtttggctgggagacaaacagaaaacactttctggaaggcacatcctcagtttatcccaaggaaaggcctgaaaagctgacaagttgcgccagcagctgtcccttagagatgaagctgtgcccaagtgtgcagacgcctcaggtacagagggagaggggcccacagggccaaggccatggccgcatggctctcaacctccagctttcagacactgatgacaatgaaacgtttgatgagctgcacatagagagcagtgatgagaaaagtccttcagacgtgtcattggctgccgacaccgataagtccgtggagaacctggatgtccttgtggggtttggaaaatctctatgtgggtctcctgaagaggaggaaaaacaagtgcccatcccttcagagactaggccaaagacttttagtttcattaagcagcaaagagttgtaaaaaggacttcttcagaagaatgtgtgactgtgatatttgatgcggaagacggtgagcccattgaattcagctctcaccagactggggttgtcactgttaccagaaatgagatttccatcaattcaactcctgctggacccaaggcagaacatactgagcttttacctcagggaattgcttgtttacagccaagagctgctgcaagagactatactttctttaaaaggtctgaagaggacactgagaaaaacattccaaaagataatgtagataatgttcccagggtgtccactgaatctttcagctccaggacagtgacacaaaatcctcagcagcaaaagctggtcaaaccaacacacaatatatcatgccagagtaattccaggtcttcggcacccatgggcatctatcaaaagcaaaatctgacaaaaatacctcccaggggcaagtcttcacctcagaaatcaaaactaatggagcccgaagccaccacactactcccttcatctggcctggtgactcttgaaaaatcaccagccttagctcctgggaaactctcacgattcatgaagactgagagctcagggcccctctttgaattacgatcagatccacacattccaaaacattccgcccaacttccgcacagctccaggatgcccagcaggagggactgggtccagtgccccaagagtcagactccagggtcacggtcaaggcctgccattgagtctagtgacagtggagagccccccacgagggatgaacactgtggctctgggccggaggcaggggtgaaatccccttcccctccgccccctccaggcaggtccgtctccctgctggccaggcccagctatgactattcaccagcaccttcatccaccaagtccgaaaccagggtccccagtgaaacagcaaggaccccattcaaatccccgctgctgaaaggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagccttccttcttaggggtaaatgagtcaccatcatctcaggtcagcagttcctcatcatcctcatcacccgccaaaagccataacagccctcatggttgtcaaagtgctcatgagaaaggactgaaaactcgccttccagtgggactcaaagtgctcatgaagtctccccagctgctcaggaaaagttccaccgtgccagggaaacatgaaaaagacagtttaaatgaagcctccaaaagttccgtggctgtgaacaagtctaagccagaggactccaagaatccagcaagcatggagatcacagcgggtgaaagaaatgtgaccctaccggattcacaagcacagggcagtttagctgatgggcttcccctggaaacagcactacaagagccattggaaagtagcatccctgggagtgatggaagggatggggtagataatagatccatgagaagatccctttcctccagcaaaccacacctaaaaccagctctgggtatgaatggcgccaaagcccgcagccacagcttcagtacacactcaggagacaagccttctacgccccccatcgaagggtcaggcaaagtccgcactcagatcattaccaataccgccgagagaggcaattctcttacccggcagaactcttccacggaaagctctcccaacaaggccccttctgctcccatgttggagagtctccccagtgttgggaggccctcggggcacccctcctccgggaagggctccctggggagctcaggcagcttcagcagtcagcatgggagcccaagtaagttgcctttgaggatccctccaaagtctgagggactcctcatcccacctggaaaggaagaccagcaggccttcacccagggagagtgccccagtgccaatgtggctgtacttggggaaccaggcagtgaccgccgcagttgcccacccaccccaacagactgccctgaagccctgcagagcccagggaggactcagcatccaagcacttttgaaacaagcagtacatccaagctagaaacttctggaaggcatccagatgcctctgcaaccgcgactgatgctgtgagttcagaagcccccctctcacccacaatcgaagaaaaggtcatgttgtgcattcaggaaaatgtggaaaagggccaagtgcaaacaaagcccacctctgtggaagcaaagcagaagcctgggccttcttttgccagctggtttggttttcggaagagtagacttccagctctgagtagcaggaaaatggacatctccaaaaccaaagtagaaaagaaagatgcaaaagtcttggggtttggaaacagacaactaaaatcagaaagaaaaaaagagaaaaagaagcctgaactacagtgtgagacagaaaatgagcttatcaaggacaccaagtcagcagataatccagatggcggtttacaaagcaaaaataatcggagaacaccacaagacatttacaaccaactgaagattgaaccaaggaatagacacagccctgttgcatgttcaacgaaagacaccttcatgacggaactcttgaacagagttgataagaaagcagctccacagacagaaagtggatcaagtaatgcttcctgcaggaatgtgttaaagggcagttctcagggctcctgtctcatcggcagctctatcagtactcaaggaaaccacaagaaaaacatgaaaatcaaagccgatatggaagtaccaaaagactccctggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttgca

SEQ ID NO: 13469 - DNA, 1815 bp, Homo sapiens
  ENST00000639875
aatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcac

SEQ ID NO: 13470 - DNA, 2390 bp, Homo sapiens
  ENST00000409213
gaagcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaagggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgc

SEQ ID NO: 13471 - DNA, 365 bp, Homo sapiens
  ENST00000473859
ccaactgaagattgaaccaaggaatagacacagccctgttgcatgttcaacgaaagacaccttcatgacggaactcttgaacagagttgataagaaagcagctccacagacagaaagtggatcaagtaatgcttcctgcaggaatgtgttaaagggcagttctcagggctcctgtctcatcggcagctctatcagtactcaaggaaaccacaagaaaaacatgaaaatcaaagccgatatggaagtaccaaaagactccctgaatccaactgccagatgagaacattggacagtgggatcggaacctttccactcccagactcgggaaatcgctcgacaggacgctacctatgccagccagactc

SEQ ID NO: 13472 - DNA, 2158 bp, Homo sapiens
  ENST00000427594
gacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccagaaggaggaaaatgtaacaagatgagaaaagctgtcaattgacctttggacaagcatcagcacagagctcttctcctcttctgcacttgttcccatgtctgactgttcgtcaactttgacctgtctcagaggctggctctcctgagtgccttgctcctcctgatgaatacagagggcaattttctgttgatttggaattgctatttccacatcatcagcaatatttctgcctgagacttttcataaaaattggggcctctcatctgctgctctgtgtgaatctaccagaagttgaagatggtaaagcaacattggttcaaggataaattttcttcaaattacaacagatggaagaaaagattttaaatgacctcttttaaaatgcctggataacataatatggatcatattttggtgtcagaagtttgtatcttagtgatctagcatgtaagctctcccttaagcaatgcaaaggaaagccaaaaccaattatgtagcaaactggaaagaaaggctgttttcggctccttgggcaaatactaacttactgaaagctgaacattactttattgttttgtatttctctttctgcctaataaatgatgaaatggtcacatgtttcttcttaaatttttttaaagaggtatatgtttttgagtagacaacgtgaaagtcatgttgcctattattcatccctgtagagaaaacagtattaacacagagtatagttccaatttcattgcaaagagcactatcttatttaatgggttgtccaggacctggtgtcagtgtacctctaagtagcttaataactctggttaagtaatttgacccttttgggtctcaatttgctcatctgtaacatgagtaaattcaattgcattatagttttataatgctttttatgctttttaaaaggccctgcattagaaatgaaatgtacttacttattgggtgaagtaataatttcacatttgtaaccaggccttcttgaagattctaacaatgagttttatgttgaggtcttggaggagactgtcttattgtccatgctgtaatcacagggaggctctgtgggactgggttttggccatgtctattttggttacttgactctggagaagttgagattagaaaactgccgagcctagatgaaaaatttctgttgggaacagccaaaattaaatactggggaacttggctggcaaaaggaagttaagatactctgctgtgaacatataaccaagattgctcttggctctgatgttgtccactttaggatttatttgaactggtttggtaaaaagtctaaacagagataactttatgacaaccagaattgttttcactttttaacaatttctctgaagaaagagccatcaataaaaataccaatgatttagtctctcctctaaatatgttttaataacatattataacttctgatacattactgttcctactccaacacattttttcctttaagaaaatgtgtgagatacagaataatgttttaaaactgaaaactgaattgatttctactttcaataataaatgttttattttttggtgtggtttatagaaaatccacttttcttacgtttatagtttagataagtttggacaatcattgaccctcatgtaactaccaccacaattaaaatacagaatattttcatgtcctggaccagttctctccctccctctttgttctcatttccctcccaagcccctggtaactactagtcttatttctctccttatagttttgccttttccagaaaggcttataaatgacgaagtcataaagtatggaactttttggtctggc

SEQ ID NO: 13473 - DNA, 388 bp, Homo sapiens
  ENST00000358991
caggctttgcagagtttagagcatattctacccaactggccccagatggaaaatactgtcttgaaattggatggctttttaagtgtagctctccacagcctgctcaaagaaaaaaaaaaatgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatg

SEQ ID NO: 13474 - DNA, 7593 bp, Homo sapiens
  ENST00000317721
gcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatgcatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaaggcaatcatcacaaaactgggataaaaggctaagtattgattcttcgctcccaagtggctttgctagtcctacaaatgaactacctccaactcgtatcaaggaaagccacattttggaagggctaagaaagctacagaagcgaaaagtgttacttgaacccccatcagtgataaccaaatggggttataaagattgcatgaactcgaatgaaggaatatattctcctggaattaaaagtagcagcctcaaggagtatcccccctgcaaaacagctgacctggggagcccctgcaaggaaccccacaagacatttgtttatgatctagattcccacgttgatgcggacgatgacccttccaccttagcattgctccaagcagttccaaaccagagctgcaggccacatggcagtaaattaacccacagtgtttccgacagtctgtttggctgggagacaaacagaaaacactttctggaaggcacatcctcagtttatcccaaggaaaggcctgaaaagctgacaagttgcgccagcagctgtcccttagagatgaagctgtgcccaagtgtgcagacgcctcaggtacagagggagaggggcccacagggccaaggccatggccgcatggctctcaacctccagctttcagacactgatgacaatgaaacgtttgatgagctgcacatagagagcagtgatgagaaaagtccttcagacgtgtcattggctgccgacaccgataagtccgtggagaacctggatgtccttgtggggtttggaaaatctctatgtgggtctcctgaagaggaggaaaaacaagtgcccatcccttcagagactaggccaaagacttttagtttcattaagcagcaaagagttgtaaaaaggacttcttcagaagaatgtgtgactgtgatatttgatgcggaagacggtgagcccattgaattcagctctcaccagactggggttgtcactgttaccagaaatgagatttccatcaattcaactcctgctggacccaaggcagaacatactgagcttttacctcagggaattgcttgtttacagccaagagctgctgcaagagactatactttctttaaaaggtctgaagaggacactgagaaaaacattccaaaagataatgtagataatgttcccagggtgtccactgaatctttcagctccaggacagtgacacaaaatcctcagcagcaaaagctggtcaaaccaacacacaatatatcatgccagagtaattccaggtcttcggcacccatgggcatctatcaaaagcaaaatctgacaaaaatacctcccaggggcaagtcttcacctcagaaatcaaaactaatggagcccgaagccaccacactactcccttcatctggcctggtgactcttgaaaaatcaccagccttagctcctgggaaactctcacgattcatgaagactgagagctcagggcccctctttgaattacgatcagatccacacattccaaaacattccgcccaacttccgcacagctccaggatgcccagcaggagggactgggtccagtgccccaagagtcagactccagggtcacggtcaaggcctgccattgagtctagtgacagtggagagccccccacgagggatgaacactgtggctctgggccggaggcaggggtgaaatccccttcccctccgccccctccaggcaggtccgtctccctgctggccaggcccagctatgactattcaccagcaccttcatccaccaagtccgaaaccagggtccccagtgaaacagcaaggaccccattcaaatccccgctgctgaaaggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagccttccttcttaggggtaaatgagtcaccatcatctcaggtcagcagttcctcatcatcctcatcacccgccaaaagccataacagccctcatggttgtcaaagtgctcatgagaaaggactgaaaactcgccttccagtgggactcaaagtgctcatgaagtctccccagctgctcaggaaaagttccaccgtgccagggaaacatgaaaaagacagtttaaatgaagcctccaaaagttccgtggctgtgaacaagtctaagccagaggactccaagaatccagcaagcatggagatcacagcgggtgaaagaaatgtgaccctaccggattcacaagcacagggcagtttagctgatgggcttcccctggaaacagcactacaagagccattggaaagtagcatccctgggagtgatggaagggatggggtagataatagatccatgagaagatccctttcctccagcaaaccacacctaaaaccagctctgggtatgaatggcgccaaagcccgcagccacagcttcagtacacactcaggagacaagccttctacgccccccatcgaagggtcaggcaaagtccgcactcagatcattaccaataccgccgagagaggcaattctcttacccggcagaactcttccacggaaagctctcccaacaaggccccttctgctcccatgttggagagtctccccagtgttgggaggccctcggggcacccctcctccgggaagggctccctggggagctcaggcagcttcagcagtcagcatgggagcccaagtaagttgcctttgaggatccctccaaagtctgagggactcctcatcccacctggaaaggaagaccagcaggccttcacccagggagagtgccccagtgccaatgtggctgtacttggggaaccaggcagtgaccgccgcagttgcccacccaccccaacagactgccctgaagccctgcagagcccagggaggactcagcatccaagcacttttgaaacaagcagtacatccaagctagaaacttctggaaggcatccagatgcctctgcaaccgcgactgatgctgtgagttcagaagcccccctctcacccacaatcgaagaaaaggtcatgttgtgcattcaggaaaatgtggaaaagggccaagtgcaaacaaagcccacctctgtggaagcaaagcagaagcctgggccttcttttgccagctggtttggttttcggaagagtagacttccagctctgagtagcaggaaaatggacatctccaaaaccaaagtagaaaagaaagatgcaaaagtcttggggtttggaaacagacaactaaaatcagaaagaaaaaaagagaaaaagaagcctgaactacagtgtgagacagaaaatgagcttatcaaggacaccaagtcagcagataatccagatggcggtttacaaagcaaaaataatcggagaacaccacaagacatttacaaccaactgaagattgaaccaaggaatagacacagccctgttgcatgttcaacgaaagacaccttcatgacggaactcttgaacagagttgataagaaagcagctccacagacagaaagtggatcaagtaatgcttcctgcaggaatgtgttaaagggcagttctcagggctcctgtctcatcggcagctctatcagtactcaaggaaaccacaagaaaaacatgaaaatcaaagccgatatggaagtaccaaaagactccctggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttgc

SEQ ID NO: 13475 - DNA, 3636 bp, Homo sapiens
  ENST00000405974
gcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatgcatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaagggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttgc

SEQ ID NO: 13476 - DNA, 588 bp, Homo sapiens
  ENST00000582812
atttcccatccttgcgtatctttggtcggacggtgattctcactcttcctattgacttctactttgtgtcagcaagttcagcgtgggccccgtatgctgccgtggatctgatcagctgaggcctgagacacaggaccaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggc

SEQ ID NO: 13477 - DNA, 565 bp, Homo sapiens
  ENST00000579150
tttcccatccttgcgtatctttggtcggacggtgattctcactcttcctattgacttctactttgtgtcagcaagttcagcgtgggccccgtatgctgccgtggatctgatcagctgaggcctgagacacaggaccaggactgttttgtcttggcaccaggtccacaggaaagccttcattcatcccctccctgtctgtgatctcatcagccagagcacagcttcacccagggaagcagagccccagagcctgaacgagctgtaccagtccattgtcccaggccactggccttgaagcttgctctgtcacccagtggcatgatcttggctcactgcaacttccacctcccaggttcaagcggttctcaagcttcacccacctgagtagctgggattacaggcacatgccatcacattcagctaatttttctatatttttagtagagacggggtttcaccatgttggccaggctagtcttggactcctggcctcaagtgatctacccgccccaggtctcccaaagtgctgagattacaggtgtgagccactgtgcccagccaaggt

SEQ ID NO: 13478 - DNA, 577 bp, Homo sapiens
  ENST00000580237
tgtgtcagcaagttcagcgtgggccccgtatgctgccgtggatctgatcagctgaggcctgagacacaggaccaggctttcttgatcatggatggtgaagatataccagatttttcaagtttaaaggaggaaactgcttattggaaggaactttccttgaagtataagcaaagtaggcggggccatctttggcccgttttgcatgcactgattctgcctcatcattttggtcatttggagattctgataagctgtctggggctccatagaacagactttacgttctcctcagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacga

SEQ ID NO: 13479 - DNA, 555 bp, Homo sapiens
  ENST00000582665
gtgcgtcacagaatggcctcggacacccaggcagtccctgacgtgtcggggaggagccgggcgcggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatg

SEQ ID NO: 13480 - DNA, 551 bp, Homo sapiens
  ENST00000579880
agaatggcctcggacacccaggcagtccctgacgtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagagtttactaagtcttatcaaaccttttactgccctttcattattatcaccgaagtcagttattctattgtgccagtggatatgaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacag

SEQ ID NO: 13481 - DNA, 2372 bp, Homo sapiens
  ENST00000334527
agaatggcctcggacacccaggcagtccctgacgtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 13482 - DNA, 454 bp, Homo sapiens
  ENST00000585098
gtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgcatgcagtggcggctactgggccctgcccagccccggaactctgcgcgatatcaatactggctattttctcttctcgccgtagtgccgttggtttcacatgattgcacttttgtg

SEQ ID NO: 13483 - DNA, 2181 bp, Homo sapiens
  ENST00000380025
gggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtagggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 13484 - DNA, 1858 bp, Homo sapiens
  ENST00000402554
ccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaagggcaagaaaaagtcatatttcccacgttgttcatggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctg

SEQ ID NO: 13485 - DNA, 577 bp, Homo sapiens
  ENST00000584866
gcggaggtacgctgagtggagctcggggctgcgtaggggagctgagccgagcggctgggcgggcctggccgggccggcggaggggagacgtcggttgagcggcggcgaacatgcgcttttgacacattggagaagaccacgtggccttaaaccaactgctgcaactctgtgtgcaggatgattctgtgggcccaagtcacccagcgcctatgctgcaaccaaaagtgcctcctgtcgctttgtatcaaaggacctttgtcatgatctcattcacaatattggtggtccctgagagtggagcagtggagtgattgacgtgcctgagtttgaagagagttaaccactggaatctctcatgttttattccctccaaaatgctgcagttcagtgttgtcccagattttatgcttgtgcttagatttctctgttctctaatttgttaagtttgtctttaatatttcacaggctttcttgatcatggatggtgaagatataccagatttttcaagtttaaaggaggaaactgcttattggaaggaactttccttgaagtataagcaaagcttccaggaagctc

SEQ ID NO: 13486 - DNA, 602 bp, Homo sapiens
  ENST00000582490
acgctgagtggagctcggggctgcgtaggggagctgagccgagcggctgggcgggcctggccgggccggcggaggggagacgtcggttgagcggcggcgaacatgcgcttttgacacattggagaagaccacgtggccttaaaccaactgctgcaactctgtgtgcaggatgattctgtgggcccaagtcacccagcgcctatgctgcaaccaaaagtgcctcctgtcgctttgtatcaaaggacctttgtcatgatctcattcacaatattggtggtccctgagagtggagcagtggagtgattgacgtgcctgagtttgaagagagttaaccactggaatctctcatgttttattccctccaaaatgctgcagctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactg

SEQ ID NO: 13487 - DNA, 552 bp, Homo sapiens
  ENST00000580738
gagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggtaattgcagcagtagacgctggggtctaatgtgttgagttttattaaaatgagaaatatgtttttcaggtgcttaagagcagctggcgacaaaaaatagtttgaaaaaaacgcttaaagtgaatttttgaataaaatgttttctttcacggaaccaggggaaaaggtggtttagagttta

SEQ ID NO: 13488 - DNA, 567 bp, Homo sapiens
  ENST00000583066
gacacattggagaagaccacgtggccttaaaccaactgctgcaactctgtgtgcaggatgattctgtgggcccaagtcacccagcgcctatgctgcaaccaaaagtgcctcctgtcgctttgtatcaaaggacctttgtcatgatctcattcacaatattggtggtccctgagagtggagcagtggagtgattgacgtgcctgagtttgaagagagttaaccactggaatctctcatgttttattccctccaaaatgctgcagttcagtgttgtcccagattttatgcttgtgcttagatttctctgttctctaatttgttaagtttgtctttaatatttcacaggctttcttgatcatggatggtgaagatataccagatttttcaagtttaaaggaggaaactgcttattggaaggaactttccttgaagtataagcaaagagtttactaagtcttatcaaaccttttactgccctttcattattatcaccgaagtcagttattctattgtgccagtggatatgaaagcttccaggaagctcgggatgagctagttgaattccag

SEQ ID NO: 13489 - DNA, 790 bp, Homo sapiens
  ENST00000580012
cggcgccgaggcctgcccttggggagccttcccggcccggggccgtgtctgaggctccgccggggcgggccgggccgggttccggggcggccagcctgggggcaactgttccaaccgctctaactgtcccctcccttccctggtccgatgtgtggccccccaggggcgcctgcaagggaacgattccggtggcctccggaagatgtgccccgttccgggtagggtgagggctggcggtgacggaggccgggacgtggcaccgtgggctggggcgctggcggcgcaaggagtggcccagtcggaggtggcagcggcgcgcccagcccgcctcctcctaccccctcttcgaaattccttcatttgcgagggtggcttggagcggggttgcattttgatctctcagtgcctctctcccatggggggcgagagcgcgagcagcccacgttgggctcggattggcattctcctgactcccgcccggaactgctaatcatcctccccctggagttcggcaaagtgtcaccaacgggctcgggttacttgtgctcgactcttttcttgctgtaagccatgagatgaccctttaagttttgcaaaggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaa

SEQ ID NO: 13490 - DNA, 560 bp, Homo sapiens
  ENST00000581189
cttgctgtaagccatgagatgaccctttaagttttgcaaaggaggctttcttgatcatggatggtgaagatataccagatttttcaagtttaaaggaggaaactgcttattggaaggaactttccttgaagtataagcaaagagtttactaagtcttatcaaaccttttactgccctttcattattatcaccgaagtcagttattctattgtgccagtggatatgaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagacttt

SEQ ID NO: 13491 - DNA, 749 bp, Homo sapiens
  ENST00000582277
acgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggcagagcaggtacaactctagaaacgctcacaatctctgaaagcagctgggattttctgccgtcctcaataattatggcacatgtgtaaaggagcagattcgacacacggtgcactctgaataggctcttatccttgcagtggagtgttttggttgatctctgtccctgattttaccctggagaatatacatttcattaaggattttgtattaaaagcacatcctaaaacatcactatacaaattagaa

SEQ ID NO: 13492 - DNA, 582 bp, Homo sapiens
  ENST00000581679
tttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggatgtgttctaacacgaatgaacaggatactgacccagagctgggctttgagagcctgcaccccttgttgtggaggccgcaccctctgccctacctgtttgatcagcagccgcttcttctcttcattctgctcatccctggtttgcaggtctctctcgaactgcgc

SEQ ID NO: 13493 - DNA, 1802 bp, Homo sapiens
  ENST00000583683
tttgggggagagacatcatcaaagtaggtttgtgtgtgtgtgcatgtgtgcgggtgtacatgtgttcaccttcccacccgctgaaacttcagatgcagtgaagccttctcacataaaacaatataccttaactgggcgtattgctctgtgggattcaaaagtattttgtaaattctggtcacttgagggcttcttggaatcaggtttttgtctagtctgtgagcacttctgccagttcctgaaacatgggctgccgtgcctgcttcccaggtgccgagctgtttccttcaaccatggtcaccctttgtctcaccatctgaaaggacacacatttcatgtggagtgtggtcgcttggagtctctcaaaaacactcttttttttcccataactttatgtagtttcttaggtaacatgtgctctatttttgtaagccactctgagttcttttgggctgtgtgtaggtgggcatggactaattttagggcgtgatgtggaaatagtattcgtattactgtttaatatgttctcctttcttttattaggcaagaaaaagtcatatttcccacgttgttcatggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacag

SEQ ID NO: 13494 - DNA, 3927 bp, Homo sapiens
  ENST00000578172
tatagctctggaaccttttttttacatatatgattcccagatctgtatcttcaagcctgccccatcactcttccttcagtcctgtcttgtgcactgggacattgccctgtggctctttgctgctccctgaaactgaatctgttgaatatagagtctcttctcttgcaaatcttttccccatgcacagctttgcaggcctctgaaggacttcactagacctgtcatcccatctagaaggccagctttcttctctctctgttctttaactttctactttttgagtcaggagagaggcgctaggtgagaccctggtggattgatgttccctctctactccacccaccttcacattaagcgttccatttctgcccatgtagaaatttaccggttctctctttatagtctgggctgcaccacttacttttcccattagagccggcctgcattggagtgccgaagtggttgcttctgagggctgctaggtggcctctgaccaggaggagactagaaaagggtcctggcctgggcatctggaggcagctgtggccccgacttccccatcagtggctcactaggtgagcctaggctaatggctggaccttctcttgctttggttgtcttggcagtggaacagtgggatgaacctgttgttccttacggtgcacttgaaaatgccagaatcccatcctcaacctgcttgaggagccatctcctagttgctgcttttgtacacccccgtggcccaggtgccagattcttcttggcatccaatggtgctccctttctgctgggttccgggcactgtctgcagtacaggtttaggggcttgcctgccactgtgatgtgtgaggccaggaatctgaggttcacacgtgctgagagctgcaggcatttgtggggcctgcctggttgtccctgaggtttctaggagaagcaggtgtcagggactctgggactagccagacagatggagcctattatatgagggctaccgtggcaaataggatatggccttggccccagaagaggcacaggcctgtgaccttgggagagtgggaaggatgatttcaaacttgcaaatgtgttgaagctcaaaaatcagacctaacccagtgaggaaagagacaatctggctgtttgtcgtcgaagtaggacagtgtgcaacagggagaaatgacatttgtcagagcctttctcctggggctcttggtctctgtatgcgtggttggaatttaaactccacatatgtactctgagtttagtttctttagacatgaactttgtttcttccaagtaggcagggactatttgtcaagtctctgcatgcctgtttgtctgtgaggttatcctcaccccgtcagtgtacgaaacagctgtctctgcagggagtgtgtgtcggcattttttttttttaaggagaacctctctccatgagtctgtatttagctccctggagccgtctgatgagtaggtgggggcagtagtgggcaggtgtggtgcagtgtggccccttgtcgtagttggctttatctcccaaattgctagtgggacaaattttcctaggaagcgtttcaaggtggaaaggctgaagtggctcctgagagaggttccaggctgcacactccctccccctcttgctgcttcctgtggctgcgctgcatggtgcgtgagggggatgcttggggggctccctgcatcgctgggctctgggtgcgtgatggggacgctggggggctccctgtgtcgctgggctccgggtgctgggtcctggctgcaggctattgggttgggctgggctgtctgcacacgagtctgcgttgaaaagcctactcatctggcgttgcttgctaaacaatttttaaaaggttatttttctccaccttattaagatattcgtgtattaatacattatatttggaaaatgtaaggagatttggaaaatgattaaaaaaggataaagtagtaaacaaaattcacccacagcccagagggaagaaaagtaacgattcttaaattttctttttatgatatatatgatcctatgtacatatatgttggtgtgtgtatatatatatgtgtatgcgtatatataatgtatgtatatatacatttatttatacacactccccctctgtccctgctttgtggatttagctgcatggatagtaatgtctatctaaggggctatagtctagaatctagaatatatactatttgcttttttttctttcatatcattgaatctacagagtttggtaacctgcatctttttccacttagtgttagttacattctgaatattttcccatgctattaaaaaacttgtggaatgtgtttttaatggctgtgcaatatcttattgttcagttgtaccattatttatttaactagttccctattgccaggcatttagacctgctttatggggaaagaatcaggactgtggcttccgtggccagtgtgcggcagttgccaaacaggtcatgtggtcctggttccccaggattcccaaaggctcaattctctaaccagctggtgctttccaggcagccagtgccccttgggccatcaggaccctacagcctgcgaggaatagttttagaaagcagattaatttcctattgtgtgtgagtgattttaaatgagtttttcgtttcccctttcttcccttctgtgctctggttgctcccacagggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaagg

SEQ ID NO: 13495 - DNA, 2885 bp, Homo sapiens
  ENST00000379692
ccgcgagagagtggagctaactgagcagcgcacccgccacggccgctgccgccccgtgcgcccggctctcccagcaccccgcgcggcgctccagccaggcgcctgtgcgactagcggcggccggcgaagcccgcgccagccccgcgggtcgctgcggcatcctcccgccgcccagcccccgcacgctccctgcagtttaaaaggacctcccgccgcttctcggcgctgccccgggattccccagccccgcgcggctccctactccacttcgcagcaacttcggcgaccgcgcgccgcccgccctcgcccgcctttgaagtttgctgtgccgaccgcaaagttgggacacttcagcggattgaatttttctcttttatctgcctccgtccccgccctccaggcttctcgttcctggatattggtgcttagcatcttggcagggtccggggacgtggactatttcgcacaccacaccacggggagggatttttttctattttccctacgaaaaacagatctttttaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaagaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatccggtttatatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaagaacatcttcaccgtctctgatctgaaacccgacacgcagtactactttgatgtatttgtggtcaacatcaacagcaacatgagcaccgcttatgtaggtacctttgccaggaccaaggaagaagccaaacagaagacagtcgagctaaaagatgggaagataacagatgtatttgttaaaaggaagggagcaaagtttctacggtttgctccagtctcttctcaccaaaaagtcaccttctttattcactcttgtctggatgctgtccaaatccaagtgagaagagatgggaaacttcttctgtctcagaatgtggaaggcattcagcagtttcagcttagaggaaaacctaaagctaaatacctcgttcgactgaaaggaaacaagaaaggagcatctatgttgaaaattctagctaccacaaggcctactaagcagtcatttccctctcttcctgaagacacaagaatcaaagcctttgacaagctccgtacctgttcctcagccaccgtggcttggctaggcactcaggaaaggaacaagttttgcatctacaaaaaagaagtggatgataactacaatgaagaccagaagaaaagagagcaaaaccaatgtctaggaccagatataaggaagaagtcagaaaaggtcctctgtaaatatttccacagtcaaaacctgcagaaagcagtgaccacagaaacaattaaaggtcttcagcctggcaaatcttacctgctggatgtttatgtcataggacatggggggcactctgtaaagtatcagagtaaggttgtgaaaactagaaagttctgttagttaccttcttatagagatatattatgtagaactccaggagggacattaaatcactttaagtataaactgactactcccacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaaatcattcctctctgtagatgctaggatatatataaattattttataaattcttgttttaaatgtcagtgtttctatgattgtaaactattaaattcttttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtacataaaattaaagagattagattatatactgttcattttcccaagca

SEQ ID NO: 13496 - DNA, 917 bp, Homo sapiens
  ENST00000506900
tcaggacagggtcttgctctgtcgcttaggagtgcaatggtgtaatcttggctcactgcaacctccacctcctgggcttaagcaattctcctgcctcagcctcccaagtagctgggaccagagagacagggtctctctttgttgtccaggttcagcttcaagtaatcttacagcctcagcatcccaaagtgctaggataacaggcatgagccatgacacccagccaaatattcttactggtactttatattgtgtattttaatcagattgtctagtccttctaacagccgtgaaattagcaaaatggctggccatccaaatgcaaactgatacaattcttttggtgatctggaacctcttgagcagcagaagcagcagatcattaatgaggaaggcactgagttattctcctacaaaggcaatgatgttgagtattttatatcgtctagttccccatccggtttatatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaa

SEQ ID NO: 13497 - DNA, 564 bp, Homo sapiens
  ENST00000515757
agagtttccctctattgtgcaccccggtctgcttgacagtgtgatggtcccgcgtgcgcgtctcctgggttttgcagctttgtcgggggctcggtgggcctccttcattctccccgagtggcgctaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaagaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatccggttta

SEQ ID NO: 13498 - DNA, 560 bp, Homo sapiens
  ENST00000511408
ctttttaaggtaagtggggagaggaaagcaatgccccagagacccgacgccttagcccgccaccctgagacctagcacaaggagcgttcacgcccgaagggtcatccgagatgggggctcgaggcacgcgcccccaaatcttcaaggcccaagaagcttctcaagggcgccctatccgtaggagctgagggcatgaggggcaggagcaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaagaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagat

SEQ ID NO: 13499 - DNA, 3014 bp, Homo sapiens
  ENST00000323851
cccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcgg

SEQ ID NO: 13500 - DNA, 2810 bp, Homo sapiens
  ENST00000521438
cagagggcggatctgtggaaattctttgaagactgtgaagctctgtggaagtggctaacaaagttgcttacattcaaggtggagcatgccatagtcaagtcatgagctttgggaagtggaggatacattggaagcatcattcaggaactcactcgttcttattttgcagttatagtttgttagacacatacagccttttttccagaagtgctgtcccaggactaggacagaccctggcgagttgtaactcggctgaacagcagccacactcagtgctgtgggcctgtcagccatggtccggccctgacatgactagtggctcttctgaccctactgcttggaactataattcgtgtgtcctcccttactaggaagttattgaacttctgatcccttttatcatttccttaaactgtttgcccatgtatagtaagagtatgcttggtaagctgactgcagtcctagcattggccttagccatgattagctctagcaaggcgaggctggcaggtttgatttccatgcctcaggctcaggcaggatccacatccccaggtgccctcttccaacagaagctatctgctagtggggctcctgcctttctagcctgctttccccgacggaagttgcaggcaaaggttgtcattggagacagccatggagacagccgcggggcagtcctgctttaccctgcacggtgtgaattgtggctcccatttgtcttggtcccgccagggtttggatttctgctttgagagtgtgttctggagagaaaggaagtgaatgctagacctcatctttctccccaaatcggcttctattaccagaaagctgaagcctcctgcaggtcttggggggaaaataacaggaagagctatggtctcaaaggcatcagccaaagagaaggaaaggaaccggtcactggccttctgcacaccacggggtgctggcttgatgaaccctttgcacacctggcatcagtgctcactgtacgcttctcatcctgctcagtagacatcccagatttgtgggtgagaagtaggggctcagagaaatatgtgagctgcggatgtggcattgaccccaattctttctgaattcaaaactagctctttaagacaattcagcaaggattaattctgtttgggagtgcctgacatcaaaagcccctccctgtgcctatcaaggagataacataagccctgcatgcttggtgtggatcaactgcccctgtttctgatgtctgactcagtgtggcctcctagccatgatgcttcagttgggtggagtactagtttcctaaagctgccgtaacaaatctccacaaactgggtggctgaaaacaatagaaatccattctctcaaagttcaggaggcctaaagtccaaaatcaaggtgtgggcagggccttgctccctccaacgctgctgtggaagaaccttccatgcctcttcctggcttctggtggccccagcaatccttggctttatgtggcttgtggctgcatcactccaatctcagcctctgtctttgcgtggacttctcccctgcatatccctgtgtgctgtttctataaggacatcacagtcattgggtttagggttccctctcaacccaggatgatttcatctcaagatccttaactaattacatatgcaaagaccctatttccaaataaggttcccttctgaagtttcaggtaggtgtgaatcttccgggacactgtcccacccggtacaggtgggcaggattgttcctcctcattccaccccatcagcacgtgctaccccatcagcatgtgccacttgcacgtgccatgtgcaagagcatttgaggtctcagagaagatcccaaagaatagacagcgcccttgttagcacctgggctgacaggcttctttgggagagatgacaacgaatagccatgccgggaacttgccgtgtggcccctctccctttccccacctgtgatgtgcagggccactgaccccaggtgtcctccctgctccagtgatcatggacagcatggggtcatgggcgtacacacaggtgctgataccaggggtcagtatttaacatacttgctttacagatgggaacagggaggctcagggggacactctcaaaattacacagcttttaacaggtggcagaattggggttcagacccagatctgggttcaagtcactcatggtgtgattgcggcagttccttcccgcatctgggccttgccatctctctctccgagtggacatggagaggacgggggcccagcagctggatggctgcagggatcaagtcttctctggggctggcacgtagaagagcatgtggctggtggacgggcatgcctggctcctcacctggcagtctcctgccctctaaccggctgtctcttgttcccctagtgccctcggctagcatgacccgcctgatgcggtcccgcacagcctctggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 13501 - DNA, 2145 bp, Homo sapiens
  ENST00000521026
ggacaaggcagggcagggcagcgggcggatgggcatcctttcggaaaaaattcatagagcgcagagggccttggctgtggtgtttggcactaacgagcttccctctctcctagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 13502 - DNA, 2349 bp, Homo sapiens
  ENST00000521414
tttcctgttgaggaagcaaaggcgcaaagagatcctgtgttctccccaaggccacacagctagaaagtggcagagcatgatttggatcctgcttgtctaactccaggctgtgagctgggaaagagcttctcatgttgggagctgcaagatagcagagaggccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 13503 - DNA, 3983 bp, Homo sapiens
  ENST00000519278
tcttcatagtaactctaggaggtgagaatttttatcaccgtttcagaggtaaggactcggtgtggctaaggggattgtccagggtcacataaagctaggcagtagaacggggactggatgcagcttgctttgactttgtggttcgtggacctgaccacccgtgcccctggggctcctgtccagggtgggagacaggcaggcctggcaagcagggtaggctgcctggaggagaagggacctgtgctgtcttgggaagctctgtcctggctggtgtcctaaggttccttgtttatcttttaaaaattatcattgtggtgtttttgtttttgtttttttccctgtaaaggcctcagtgttggccaaggagagggggaggtcattccagttgaaataggacagagtctttcaagctgaggtgatcgcagcttctcattctgcaagtgcatttttgcccaattttgggtggctgccagggaccgatggtttgaaggggccctgcctcttgccccatcccctgccctgtaccagccactgtgattttgcatttgttctttgaacattcctccagaatgcaggagcccttccgtccagcctgtatgacgttctggagtggaacacactccctgttttttatttgattttccagcaaaggaagtgacattccagtcaacccgctgggcttcatgatagctgtcctgagtgagactcgaaggtctggggatgtcgaccactggctaatgtgaagcctgaggattgtctttaatagctgtactattcccttcagtacagctttaatagctgtactattcccttctttttcaactccagcctttcgattaccaggcattggtattagatactgtgatgtgtgcagttacttcttgcagtccttcccttgaccttgtggccttgaagttcctggcactcccagttccagattagaagtctgagacccagaggtatgcagactgcccagtgccacacagctaggctgtggcaggcaagggccagccaaagacccttaggtctagagcttctctcctactcatttttgcctaatgcttaggtcagcacacatttatggagcttctgctgtatactaggacttatagagctcctgctgcaaacctagtcactggggagaggtaggaaaagaagattgtcagtgtctttggtaatatcagtatacttagaaaggggaaactggcttggagatgagagaggagggatagttgggagccaagcatatcttggggtatagactggggagctcagtgtgtttttagaagaggtgaatggatggccctctttgctgaggacttggtgaatgtttggagcagggtaagctagcagtagctgggtctttattcagcacttatttgctgtgcatcttgtgcatgggcctctgaaaataaggaactggatatagtcccaggccctgcatttgggggatcaggtccaggagggaactggagacaggaactgagtttctatcaagggggatgtccttgaggcctgcatgtaggggggagtccagcaatgccaccctgcacccagggaagtggggttttgctgaccttgttaactactgttagctcctggtttctcatccacccactttactcctttccagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 13504 - DNA, 2918 bp, Homo sapiens
  ENST00000517599
aaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccagacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 13505 - DNA, 3755 bp, Homo sapiens
  ENST00000414097
acacaaacgcctcctccgggcagggcacacgcgcccgctgcacaggccgaggccctggactcggaggggactgcagagccgacccacaacccgggccccgatgcccctcccggccgcgcccctacgactgcttgcgcaacaggcggcggctccagtgggcgcccgccgcgcgctgccggagcccagcccagcccggcgcgcccgggaggagggagcagggagcggggaaggggtgtgtcccggctgcgtgctgggactgcgagggtctgggaggggcgaggcgcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggtaagcccgcgccctcttctcccaggcgcgacgcggagcagaaaggggccgcccgtgcggtgccgctggagcgccaggaccgccctttgtagccccgcgtactccaggagtaagcgccccggagctgcaagtgcgcggtcaccccggggcgcgggcgcgagggggctttgggtgcagacaccgctgaagtggggggttcaattacggaaagggaggaaaaaaagacagggtcccattcatctcccccctagctggggattggggttctggaggtcgggaagggggcgatgagacggtccgaaaaaataccaggatagcgtttcctggcgtcgtctccgaatcccagctggcgccgctggcaggggtgcgcgctggacgtgggtgcagaagggactaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 13506 - DNA, 888 bp, Homo sapiens
  ENST00000518176
cccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagccta

SEQ ID NO: 13507 - DNA, 1385 bp, Homo sapiens
  ENST00000522476
aaacctcgcctggctcccagctggtgctgaagctcgtcagttcaccatccgccctcggcttccgcggggcgctgggccgccagcctcggcaccgtcctttcctttctccctcgcgttaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaa

SEQ ID NO: 13508 - DNA, 560 bp, Homo sapiens
  ENST00000518066
aaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatcca

SEQ ID NO: 13509 - DNA, 507 bp, Homo sapiens
  ENST00000523642
cttggggaatggagtgaaattatctgtagggcctagcatagtgcctggcacgtagcaagctgcaagtgatggttgccacggagacaccagcagccttgcctggtggggctggagtgttccctacccacggtccaccctgttcctcctttgtaaggcaggacaaggcagggcagggcagcgggcggatgggcatcctttcggaaaaaattcatagagcgcagagggccttggctgtggtgtttggcactaacgagcttccctctctcctagatggcggactgtggcggcctcccgcagatctcccagccggccaagctcgctgaggccttcaagtacttcgtgcagggcatgggatacagtgagtatggcattccccgtgtgcagtgggtcggggcatgtgtcggaattggaagtgctctgtcctgagccaggtttggatgagcaattctgtgtccccctggccagcttcagctttctgggaggaaacagttaggtgtgtggagggca

SEQ ID NO: 13510 - DNA, 411 bp, Homo sapiens
  ENST00000522665
gttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacagtgagtatggcattccccgtgtgcagtgggtcggggcatgtgtcggaattggaagtgctctgtcctgagccaggtttggatgagcaattctgtgtccccctggccagcttcagctttctgggaggaaacagttaggtgtgtggag

SEQ ID NO: 13511 - DNA, 584 bp, Homo sapiens
  ENST00000517331
agaatgtgtccatgggacctggagcgtaggaagcaattgatagagtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactg

SEQ ID NO: 13512 - DNA, 1103 bp, Homo sapiens
  ENST00000522377
ctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagcctttcgattaccaggcattggtattagatactgtgatgtgtgcagttacttcttgcagtccttcccttgaccttgtggccttgaagttcctggcactcccagttccagattagaagtctgagacccagagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactct

SEQ ID NO: 13513 - DNA, 594 bp, Homo sapiens
  ENST00000521664
ctagcagtagctgggtctttattcagcacttatttgctgtgcatcttgtgcatgggcctctgaaaataaggaactggatatagtcccaggccctgcatttgggggatcaggtccaggagggaactggagacaggaactgagtttctatcaagggggatgtccttgaggcctgcatgtaggggggagtccagcaatgccaccctgcacccagggaagtggggttttgctgaccttgttaactactgttagctcctggtttctcatccacccactttactcctttccagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagacca

SEQ ID NO: 13514 - DNA, 582 bp, Homo sapiens
  ENST00000520230
agatggcagtccctccacctgggatcatgaagcaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccg

SEQ ID NO: 13515 - DNA, 581 bp, Homo sapiens
  ENST00000518010
aaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttggctaaacaaccctgagatggtggagggccttgtccttatcaacgtgaacccttgtg

SEQ ID NO: 13516 - DNA, 558 bp, Homo sapiens
  ENST00000518480
aaacaaacctcgcctggctcccagctggtgctgaagctcgtcagttcaccatccgccctcggcttccgcggggcgctgggccgccagcctcggcaccgtcctttcctttctccctcgcgttagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaac

SEQ ID NO: 13517 - DNA, 729 bp, Homo sapiens
  ENST00000519228
agtgggcaaggtccagtgagtgtgcttagaactgggaagatgaggggaagggtaagcgctgggcggcggtgggcaagatggacgagattaaacgggagcgaggatttcagcgagagctttggcgacacggaaggctgagaatcggagggagcctgtcgggcgaaagcgaaggcggctgctgggcaggcagccgaatccggctggagagccgagctggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtg

SEQ ID NO: 13518 - DNA, 550 bp, Homo sapiens
  ENST00000519580
gagaggctggtggcgcttcagtcccgtagcacacacagggcggtgtgcatgtgtgagtgcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggag

SEQ ID NO: 13519 - DNA, 581 bp, Homo sapiens
  ENST00000522890
aaaggggccgcccgtgcggtgccgctggagcgccaggaccgccctttgtagccccgcgtactccaggagtaagcgccccggagctgcaagcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggag

SEQ ID NO: 13520 - DNA, 536 bp, Homo sapiens
  ENST00000520943
agcttgccctgggtctggtcctgggctcagtggcaaattcaacgctgggcaggtggcctgaggacaatgacggtgccagctgcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcct

SEQ ID NO: 13521 - DNA, 709 bp, Homo sapiens
  ENST00000521544
aaacctcgcctggctcccagctggtgctgaagctcgtcagttcaccatccgccctcggcttccgcggggcgctgggccgccagcctcggcaccgtcctttcctttctccctcgcgttagaaggagatcacagacaccagaagacagcagcttctgccagaactgggtccttccatgattctcaggtggtgactttgaatcccagaaaaagtgttttggggagagtggagtgaaggaagagtgtgaacattggatctgactccactccagcccctgtgctgcagccagcagggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagca

SEQ ID NO: 13522 - DNA, 391 bp, Homo sapiens
  ENST00000517745
tgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggtaagagcgaaggatcagctccttctctgtctgcagagaagcctggtttctagcatcttcctgccccttggctttgatctggactgaccactaaaattaaggttgcaatttagagatgaggcaagaaattagctcgtcactctgtgaacactgttcttcacacagtctctga

SEQ ID NO: 13523 - DNA, 347 bp, Homo sapiens
  ENST00000518094
gaaacaaaatgaatgtgctttgccaccgagacacctaatttttttctcatcttacttttttctcttctctccctcactgctgttcttcagacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggtaagagcgaaggatcagctccttctctgtctgcagagaagcctggtttctagcatcttcctgccccttggct

SEQ ID NO: 13524 - DNA, 530 bp, Homo sapiens
  ENST00000522738
agtcccgtagcacacacagggcggtgtgcatgtcaggcagccgagagtcctgcaccgtggggtgtgtatgtgtgttcacgcgcatgcgtgtgcctgtgtgtctgtgcgtctgcatcaccaaccttctgttagggctaactgtgaggctgaagcttgcactatgcctatacgtggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccc

SEQ ID NO: 13525 - DNA, 562 bp, Homo sapiens
  ENST00000523892
aaacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagattgagggaaatgcttagaggtctccactgcctcttctactcacaagagactgaaatttaatccaggtccagatgacagcagccatggaaaaaataccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagg

SEQ ID NO: 13526 - DNA, 554 bp, Homo sapiens
  ENST00000523931
aaggaagcaaggaagcgcaggcttgatggcctgttttccagatggagcaaacagtccggggcagagatggtggcgggcaagccctttccccagcatttggtgcatttaacagcgcagtctgagccaggcctctgtcccctgcctcctgggagtcccctcctagccctggtccttggagtggcttctggccagagagagctgctgcccgaagccggggctcttatggccagatgagaagagagcttcctcaaaacacagttggaaacaggctggctgtcttcagccacgcggatgccatgaaccccacatgaccagcccactgtctgctgtgtctcctcaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcct

SEQ ID NO: 13527 - DNA, 2975 bp, Homo sapiens
  ENST00000537882
gcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccagacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcgg

SEQ ID NO: 13528 - DNA, 2122 bp, Homo sapiens
  ENST00000298687
cggccccccgcattccccgcccccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgtta

SEQ ID NO: 13529 - DNA, 2127 bp, Homo sapiens
  ENST00000350792
atcctctccccaccccccgcctgcccgcgatcgccctctatttatagcggccccccgcattccccgcccccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgtta

SEQ ID NO: 13530 - DNA, 2718 bp, Homo sapiens
  ENST00000556716
gtgggagtccaggagtgggtcgagcttagcggggaggggataaggccatgccctgtttctcatttccttccttctgctgtccctcagcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttctttttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggttagtagggaattttggggtgagtgagggaggagggttggggtcctaaagtggtggtcagaagagtatcttgccaaggggatgtcctgtttggcacagggagatcaactttggggcactaagaatttgattcctggtaaggaggaactgggtagggagctgatagaaaagggactggggtctgggttcctgggtcccttacgggggaggcgccacagtgggcgtgacctcattcattcagcctcctgcttactccaggtggaatgtaactcaaaactggaccccacccagacctcgttcctcaaggtcagtaacctgttcctgggcccccgtccacagtcatatatcctctctacatgcagctgctaagcctccagggcccggcatgggagcaaatggggtgaacgaagaacaaaacaaaggggctagagtgaagaagctagggaagagagaccctttccacctctctgcatggctcatttatgtgtgtttcactttttctgggtggtgctctcctgaacagatggctgactccggaggtcagccccagctgactcaggtgagtgccgctgccgtccatgggatggggaagggacataggataccggtggcactgggctctgccctttgccacacacccggccccacagtgccgcagcctcaggctccagctcttcctctaacctcatctcaccgtctccctcgcctcttcttacttccgcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 13531 - DNA, 527 bp, Homo sapiens
  ENST00000557633
cccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 13532 - DNA, 2146 bp, Homo sapiens
  ENST00000554104
ctcttccccagtagaaggatggcctctgcttggccctctcttctctctttgctttctttccttctattctagtcctttcccttccctatctctcccctctccttccttcccctcctcttctctctctaatcttcattattctttcttatcctcaaactcatcttccggtatcatgttttcctcaattcttgctgatcctgtttttaattctttgttcccttttccctcttgcccacccactcccagctccctgaccttggtgttgctccttttctggcctcgtctcctctgagcctagctcttggtgccctgttttcctgcagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 13533 - DNA, 2216 bp, Homo sapiens
  ENST00000555158
agggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 13534 - DNA, 2162 bp, Homo sapiens
  ENST00000553503
ggcggcagcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttgggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 13535 - DNA, 2079 bp, Homo sapiens
  ENST00000397853
aagcccgagccggggcgggcccgagtcaaaggcaagtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 13536 - DNA, 2047 bp, Homo sapiens
  ENST00000360463
tctccccaccccccgcctgcccgcgatcgccctctatttatagcggccccccgcattccccgcccccacctccccgccttgttgtccaacttctcccggagcagccggagagcaggcgtcgggacgcagcaaagagaggagaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 13537 - DNA, 2880 bp, Homo sapiens
  ENST00000556147
gtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaaggtccggggcgcttggcaccggccacgcaagggtgtcagtctccacgcggacgggctgcgtagggactcgtagggacgggttccgggtgctgggcccggccggtctcctctgtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtgtttgtttttaaattgtggagggaaacagccatgctctgctaccctcctcttactggagagctgtcaaaaattttggggatcccctattcccccgcgtttagtccccctgcagatagaaaattgaggccaaatgtagtaactaactggggcaaggtcacactgggagtggcagagccgggattcgaatccggaggttctgacagggccaccctcttacctccacatcagcacttccttctctcctccgcgcagcctgaactgatgcccttgtagcctatattgattccggctcgagcctagagaggacgtgttctctggacttaggggtagacagacactggggagggttagtgacccgaggaggttgatgaccctgggagtctgggtcttggctgaggctttccgtccctgaaagaccccaggtctgtctcccatgtcattcacctcgttgctgtgttttctcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 13538 - DNA, 1919 bp, Homo sapiens
  ENST00000557353
aagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 13539 - DNA, 1980 bp, Homo sapiens
  ENST00000554143
gggtctgcgggaagcccgagccggggcgggcccgagtcaaaggcaagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 13540 - DNA, 2022 bp, Homo sapiens
  ENST00000397851
gggtctgcgggaagcccgagccggggcgggcccgagtcaaaggcaagtgaaggtggaagcggccgcggcggcagcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 13541 - DNA, 2084 bp, Homo sapiens
  ENST00000397847
attgaccccagagtccctgttggccatcctctccccaccccccgcctgcccgcgatcgccctctatttatagcggccccccgcattccccgcccccacctccccgccttgttgtccaacttctcccggagcagccggagagcaggcgtcgggacgcagcaaagagaggagaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 13542 - DNA, 1784 bp, Homo sapiens
  ENST00000298684
tgccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctccc

SEQ ID NO: 13543 - DNA, 1588 bp, Homo sapiens
  ENST00000555650
gtgtcctgtgatgctggtggtaggagaccaagcacctcatgaagatgcagtggttagtagggaattttggggtgagtgagggaggagggttggggtcctaaagtggtggtcagaagagtatcttgccaaggggatgtcctgtttggcacagggagatcaactttggggcactaagaatttgattcctggtaaggaggaactgggtagggagctgatagaaaagggactggggtctgggttcctgggtcccttacgggggaggcgccacagtgggcgtgacctcattcattcagcctcctgcttactccaggtggaatgtaactcaaaactggaccccacccagacctcgttcctcaaggtcagtaacctgttcctgggcccccgtccacagtcatatatcctctctacatgcagctgctaagcctccagggcccggcatgggagcaaatggggtgaacgaagaacaaaacaaaggggctagagtgaagaagctagggaagagagaccctttccacctctctgcatggctcatttatgtgtgtttcactttttctgggtggtgctctcctgaacagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagta

SEQ ID NO: 13544 - DNA, 2096 bp, Homo sapiens
  ENST00000397844
actcctgcgccctcgacgttcccccgtgccccctttcggcgccagcacacctgcccctgccagccggcgagacccccgcctcctcagcggcggtcccgcccacctcctcctttcttaatctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctga

SEQ ID NO: 13545 - DNA, 1500 bp, Homo sapiens
  ENST00000403829
ctcaccgggttggggacagggatggaaaatggtggttccatgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaa

SEQ ID NO: 13546 - DNA, 978 bp, Homo sapiens
  ENST00000553593
aaacagtgtgttggttggctggtggatgggtgtttgtttttaagacactagctctccagcagaaagctggggatagacttcaggtatctaccctgactacccgtgccaacctttggcttcttgggcccttctttttcgcgtcctccaaagaaagtttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcg

SEQ ID NO: 13547 - DNA, 725 bp, Homo sapiens
  ENST00000553793
gatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcat

SEQ ID NO: 13548 - DNA, 1051 bp, Homo sapiens
  ENST00000556008
aagtgaaggtggaagcggccgcggcggcagcaggtctgtctcccatgtcattcacctcgttgctgtgttttctcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatggg

SEQ ID NO: 13549 - DNA, 556 bp, Homo sapiens
  ENST00000557416
cttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgggagatcaactttggggcactaagaatttgattcctggtggaatgtaactcaaaactggaccccacccagacctcgttcctcaagatggctgactccggaggtcagccccagctgactcagccaggcaagctgaccgaggccttcaagtacttcctgcaaggcat

SEQ ID NO: 13550 - DNA, 672 bp, Homo sapiens
  ENST00000635386
ataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgacctcgttcctcaagatggctgactccggaggtcagccccagctgactcagccaggcaagctgaccgaggccttcaagtact

SEQ ID NO: 13551 - DNA, 772 bp, Homo sapiens
  ENST00000556366
gaaaggaagggtgagttctgactgggggacacgagtccctgtctgattctattgttgaggtgatgtgggttctctttagataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgagg

SEQ ID NO: 13552 - DNA, 1012 bp, Homo sapiens
  ENST00000556974
acctccccgccttgttgtccaacttctcccggagcagccggagagcaggcgtcgggacgcagcaaagagaggagagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaag

SEQ ID NO: 13553 - DNA, 1162 bp, Homo sapiens
  ENST00000555026
gtaatctcagcagttttgggaggctgaggagagtagatcacctgagctcaggagtttgagatcagcttatatagatggggaaactcccacctccctaagctaagaggcgttctatcacagtgtgtattttcatcacgagcacacatttttatttacctttcctcttatgaactgtggacttcttacaagatctcattagcaatgtgggctttctcatgtccctgtggctccgtggatgttcccaagcttactggttttggagtcttgcacagcctccttaacgtgaagacaatgaggatgaagacttttatgatgagccacttccactaaacgaatagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaag

SEQ ID NO: 13554 - DNA, 410 bp, Homo sapiens
  ENST00000554277
cctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaagtgggtgggctgtgtgtgtatgcatccgccgagacctgaactttgagcgtggaggtgatatcaccctcaggtgtcctgtgatgctg

SEQ ID NO: 13555 - DNA, 848 bp, Homo sapiens
  ENST00000553867
gcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcacc

SEQ ID NO: 13556 - DNA, 545 bp, Homo sapiens
  ENST00000449431
actcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaa

SEQ ID NO: 13557 - DNA, 851 bp, Homo sapiens
  ENST00000557169
ctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaa

SEQ ID NO: 13558 - DNA, 823 bp, Homo sapiens
  ENST00000555695
aatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccagtttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaa

SEQ ID NO: 13559 - DNA, 871 bp, Homo sapiens
  ENST00000555869
ctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacag

SEQ ID NO: 13560 - DNA, 559 bp, Homo sapiens
  ENST00000557182
aagtgaaggtggaagcggccgcggcggcagcaggccaccatggcggagctgcaggaggtgcagatcacagaggagaagccactgttgccaggacagacgcctgaggcggccaagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggata

SEQ ID NO: 13561 - DNA, 924 bp, Homo sapiens
  ENST00000555733
cgcggcggcagcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttgggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaat

SEQ ID NO: 13562 - DNA, 775 bp, Homo sapiens
  ENST00000555384
agcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccgga

SEQ ID NO: 13563 - DNA, 595 bp, Homo sapiens
  ENST00000554094
aatgttgaacttgcggagtttattcagagttgggaggaagggtcttgggaggaagggaggcattgggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcc

SEQ ID NO: 13564 - DNA, 572 bp, Homo sapiens
  ENST00000366204
gtttttaagacactagctctccagcagaaagctggggatagacttcagtttctctacaataattggagttggtgttggagctggagcctacatcctggcgagatatgctcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttctttttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggg

SEQ ID NO: 13565 - DNA, 842 bp, Homo sapiens
  ENST00000553741
gtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttctttttttttttttttttgagatggtgtctcactctgttgccaaggct

SEQ ID NO: 13566 - DNA, 587 bp, Homo sapiens
  ENST00000557728
acacgagtccctgtctgattctattgttgaggtgatgtgggttctctttagataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttctttttttttttttttttga

SEQ ID NO: 13567 - DNA, 555 bp, Homo sapiens
  ENST00000553567
aggtatctaccctgactacccgtgccaacctttggcttcttgggcccttctttttcgcgtcctccaaagaaagtttctctacaataattggagttggtgttggagctggagcctacatcctggcgagatatgctgtaagaaataaaaagcccagaggagggaaaggagggtccagactgattaggagaatactgtttattagtgctgtttgggggaggaagtgggcactaggtggggagtcaggccctgtgggagtccaggagtgggtcgagcttagcggggaggggataaggccatgccctgtttctcatttccttccttctgctgtccctcagcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagc

SEQ ID NO: 13568 - DNA, 603 bp, Homo sapiens
  ENST00000557305
ttgtgtctgttttcacatttgctttaagttccattcttcccgttcctctagaggaaccaggaactaaagcagaacaagttgaactggctcttgaaaattgagaatggacaaagagctatctatatgggaaaacagtgtgttggttggctggtggatgggtgtttgtttttaagacactagctctccagcagaaagctggggatagacttcaggtatctaccctgactacccgtgccaacctttggcttcttgggcccttctttttcgcgtcctccaaagaaaggtccgtgtctgcctttctttgtgcccgtggactcaggagggagggtgaagagtttgaagagatgggctgtggcaggttttggacagcagatcccatgaggcgtatatttctttccctttcacagtttctctacaataattggagttggtgttggagctggagcctacatcctggcgagatatgctcttaaccacccggacactgttgaaggtcttgtcctcatcaacattgatcccaatgccaagggttggatggattgggcagcccacaaggtttggaggggcctgtgtgctgagacctacggttggggatcccctcgt

SEQ ID NO: 13569 - DNA, 583 bp, Homo sapiens
  ENST00000557198
aagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaaggtttggaggggcctgtgtgctgagacctacg

SEQ ID NO: 13570 - DNA, 639 bp, Homo sapiens
  ENST00000553442
gtggggtgtcagtatcccggaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattggg

SEQ ID NO: 13571 - DNA, 671 bp, Homo sapiens
  ENST00000556420
agcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaat

SEQ ID NO: 13572 - DNA, 943 bp, Homo sapiens
  ENST00000553784
ttttggtaccctgtcctttagaatactcagtcactgagctacaagtttcactccctacctgagagtgtggggtggcccctaaatatagcccgagaaatctgagctacacttctgccccaccctggtattttggtccagggcagaggagggaggggtctggaggtgtggtgttgagggtggcagtggggatggtgagtatcaagagaagggctgtcctgattcctcttccaaagcttccaccgatcagcctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcc

SEQ ID NO: 13573 - DNA, 583 bp, Homo sapiens
  ENST00000557149
atattgattccggctcgagcctagagaggacgtgttctctggacttagggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcc

SEQ ID NO: 13574 - DNA, 609 bp, Homo sapiens
  ENST00000555142
agcgcccgtgggcgggctggggcgggccgggggcgggtctgcgggaagcccgagccggggcgggcccgagtcaaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcc

SEQ ID NO: 13575 - DNA, 560 bp, Homo sapiens
  ENST00000555767
aatctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttg

SEQ ID NO: 13576 - DNA, 669 bp, Homo sapiens
  ENST00000554531
attctaactcacaccactgcttcaccactaccctagtctctctccccatacactataattgggagtcaggcccttgtctcgtcactacactaaccttcatcctttccgtgtctctctttgtcaatctctttctgtctttggtcatttgttggtctgtctttacttgcctctctttgtctgtttgtctctccatctgggacgccacatggtcatgtgtttctgtgtgaatccgtgtgtgtctctccaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtct

SEQ ID NO: 13577 - DNA, 593 bp, Homo sapiens
  ENST00000557264
atattgattccggctcgagcctagagaggacgtgttctctggacttaggggtagacagacactggggaggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaa

SEQ ID NO: 13578 - DNA, 633 bp, Homo sapiens
  ENST00000557676
tagcgcccgtgggcgggctggggcgggccgggggcgggtctgcgggaagcccgagccggggcgggcccgagtcaaaggcaagtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttg

SEQ ID NO: 13579 - DNA, 603 bp, Homo sapiens
  ENST00000556924
gttttggtgagccgagcagagcctggaagcgtccagccgcccgcccctcgccccccggccccagcacaaccctttcctgagcggcagtctgggcgggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaacc

SEQ ID NO: 13580 - DNA, 609 bp, Homo sapiens
  ENST00000556329
aagcccgagccggggcgggcccgagtcaaaggcaagtgaaggtggaagcggccgcggcggcagcagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgct

SEQ ID NO: 13581 - DNA, 553 bp, Homo sapiens
  ENST00000554379
agcccgagccggggcgggcccgagtcaaaggcaagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccagtttctctacaataattggagttggtgttggagctggagcctacatcc

SEQ ID NO: 13582 - DNA, 565 bp, Homo sapiens
  ENST00000554398
accccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcct

SEQ ID NO: 13583 - DNA, 587 bp, Homo sapiens
  ENST00000554472
atattgattccggctcgagcctagagaggacgtgttctctggacttaggggtagacagacactggggaggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctgga

SEQ ID NO: 13584 - DNA, 561 bp, Homo sapiens
  ENST00000554483
aagtgaaggtggaagcggccgcggcggcagcagaccccagagtcagaaggagtgagaaccctgacccctaatcccactgcatccagccaataggagcccagtaagtgaccccaccccgcaggctgcaggctccttcctgtgcaggtctgtccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctgg

SEQ ID NO: 13585 - DNA, 578 bp, Homo sapiens
  ENST00000555657
aggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattgg

SEQ ID NO: 13586 - DNA, 579 bp, Homo sapiens
  ENST00000557616
ggcgggcccgagtcaaaggcaagtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccagtttctctacaataattgg

SEQ ID NO: 13587 - DNA, 571 bp, Homo sapiens
  ENST00000557274
gaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataatt

SEQ ID NO: 13588 - DNA, 635 bp, Homo sapiens
  ENST00000556457
cttaatctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataatt

SEQ ID NO: 13589 - DNA, 583 bp, Homo sapiens
  ENST00000556688
gagtcaaaggcaagtgaaggtggaagcggccgcggcggcagcagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataat

SEQ ID NO: 13590 - DNA, 745 bp, Homo sapiens
  ENST00000553862
gggaagggtagaaatgaaacccagagggaggggaggggtcagtgtgggaaggagaagttctctcctggtctgactgtggcatgaaaggaagggtgagttctgactgggggacacgagtccctgtctgattctattgttgaggtgatgtgggttctctttagataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccaggttcaccgtggttcctgagccagtttcagcttctgaactcaatatatcttcttccttcatgctcccgccttgattattgagaaaaggtggtgggtttggaaaattggccagagtcaacagaatagccctaatgggtggagggaaggaaaagggtctatgcttggccctgcctcaggctaaggagggccttctctgatcagaaagtcagggaggaatgaaagggggtgacataatccctgaggaaccagatagacctgtctctttctctcccactcccctctccttcatgcccacacctggtggatggggagctctgcgggtgagagagag

SEQ ID NO: 13591 - DNA, 657 bp, Homo sapiens
  ENST00000557669
aacttctcccggagcagccggagagcaggcgtcgggacgcagcaaagagaggagaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccaggttcaccgtggttcctgagccagtttcagcttctgaactcaatatatcttcttccttcatgctcccgccttgattattgagaaaaggtggtgggtttggaaaattggccagagtcaacagaatagccctaatgggtggagggaaggaaaagggtctatgc

SEQ ID NO: 13592 - DNA, 558 bp, Homo sapiens
  ENST00000557113
cagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccaggttcaccgtggttcctgagccagtttcagcttctgaactcaatatatcttcttccttcatgctcccgcctt

SEQ ID NO: 13593 - DNA, 576 bp, Homo sapiens
  ENST00000553900
aagtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccaggttcaccgtggttcctgagccagtttcagcttctg

SEQ ID NO: 13594 - DNA, 515 bp, Homo sapiens
  ENST00000557318
caaaggcaagtgaaggtggaagcggccgcggcggcagcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttaga

SEQ ID NO: 13595 - DNA, 632 bp, Homo sapiens
  ENST00000554561
cttgtagcctatattgattccggctcgagcctagagaggacgtgttctctggacttaggggtagacagacactggggagggttagtgacccgaggaggttgatgaccctgggagtctgggtcttggctgaggctttccgtccctgaaagaccccaggtctgtctcccatgtcattcacctcgttgctgtgttttctcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtac

SEQ ID NO: 13596 - DNA, 583 bp, Homo sapiens
  ENST00000554419
cccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatccct

SEQ ID NO: 13597 - DNA, 531 bp, Homo sapiens
  ENST00000553563
attcctcttccaaagcttccaccgatcagcctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactccactgtttcagttcgaggacatgcaggaaatcattcagaactttgtgcgggttcatgtggatgcccctggaatggaagagggagcccctgtgttccctttgggatatcagtacccatctctggaccagcttgcagacatgat

SEQ ID NO: 13598 - DNA, 573 bp, Homo sapiens
  ENST00000554489
agggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggacc

SEQ ID NO: 13599 - DNA, 580 bp, Homo sapiens
  ENST00000556561
gtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtac

SEQ ID NO: 13600 - DNA, 578 bp, Homo sapiens
  ENST00000554893
agcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttgggaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaa

SEQ ID NO: 13601 - DNA, 571 bp, Homo sapiens
  ENST00000554833
agggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcat

SEQ ID NO: 13602 - DNA, 554 bp, Homo sapiens
  ENST00000554415
agcaaagagaggagaggtaccaggactctgggcacgagggagtcggaactcctgcgccctcgacgttcccccgtgccccctttcggcgccagcacacctgcccctgccagccggcgagacccccgcctcctcagcggcggtcccgcccacctcctcctttcttaatctagttctctgtgttcgggcggggggagtcgaactcgtggggtgtcagtatcccggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgagg

SEQ ID NO: 13603 - DNA, 558 bp, Homo sapiens
  ENST00000557167
tattgattccggctcgagcctagagaggacgtgttctctggacttagggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggttattagagaccgtttgactcccatgcccaaattccagacctctaagcatcccccttgccttctaacttcccaagcgtactgatcttattctaactcacaccactgcttcaccactaccctagtctctctccccatacactataattgggagtcaggcccttgtctcgtcactacactaaccttcatcctttccgtgtctctctttgtcaatctctttctgtctttggtcatttgttggtctgtctttacttgcctctctttgtctgtttgtctctccatctgggacgccacatggtcatgtgtttctgtgtgaatccgtgtgtgtctctccaggaggctgagttagctgcccgaatcct

SEQ ID NO: 13604 - DNA, 2054 bp, Homo sapiens
  ENST00000397858
cggccccccgcattccccgcccccacctccccgccttgttgtccaacttctcccggagcagccggagagcaggcgtcgggacgcagcaaagagaggagaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgtt

SEQ ID NO: 13605 - DNA, 1309 bp, Homo sapiens
  ENST00000397856
gcggccgcggcggcagcagaccccagagtcagaaggagtgagaaccctgacccctaatcccactgcatccagccaataggagcccagccaccatggcggagtgcaggaggtgcagatcacagaggagaagccactgttgccaggacagacgcctgagggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccc

SEQ ID NO: 13606 - DNA, 2184 bp, Homo sapiens
  ENST00000394488
gcgagggcggcggaggcgcggccgggcgggtcccagggccgtggttctccagcgcaggagtccccggcgcacccgctgcgctcgccccgcagccgcagcctgagcggccgaagtcgccaccagctgtgtccgcgcagatcccgggcgcggaggggagaggtcgcccgcttgtcgcccccgccggaccccgggcaccgcgtagcacccaagcgccacccggacgaggggccctggggagcggctgaggccgaagacccgagggaaggaggagcccgcggacggctgcagccccagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatcatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaatacattctcattatttatgagaatattttaaagtatataaatatggattcctggaatcgaagccttctagataaatactgtgtagaatatggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcagggaagaggctgacattgtccttggacaggtacattcttgtggatattgatgatatatttgtgggaaaagagggaacaagaatgaacaccaatgatgtaaaggtaaggctctattttctcaagtttcaaagttcagttcatcttccagcagggatacaactatcccagtttgtactacaactgggttacccaggacatgggatttactgggaaagtctgggcaatctaggattatcgctcaccctaaatcaactaagaagattatgtatttctatctgaatcaagaaaaataaagattttactaaaagattgagtgtggcaggatcctgaaatggttttctacatgtatttacaactagagtagaagtcatttcgtttaattactttccagaaactatctacctcaaaaaaaagctattactaatctcagacttagctcatttaaatatgaaattaaagtgaatttgtcttaatgataataaatatttccacaaatttcaagaattacagatctcattgtagcaagttcagatacttttggaagtcaaatatgcagtgcattttctcttatcatatttttctgaaactgaaaatcagtactactaaatatgaagatcaatgactgtataagcatatttattcacatttaaacatgaggatttaacttgatttcagcgaacacttctgacacatatatgaagccaatcatgccaaatttaaattgtattacatttcttattgtgtaaaactgctgcccttaaacagaaaacaattatttgaaatagtttgtcattattatgagttgattgtgttacataaacagctgattgtttactattaaaaaattttaaaatta

SEQ ID NO: 13607 - DNA, 5961 bp, Homo sapiens
  ENST00000296499
ccggtcccttggcgacgggtcttgcatgtgacactcttgccctctagtgcctcaccagcttggtagcagtttgatggctaatattaataagatgttacataacatgagagtactgggccaggactggtgttgctaccacttgtaaagtcaaaaagcctgagccgatggtaacgagtggtactgtttccgtttcttttccatctattgcaactttctcaagcattttcagctctgaactttaattccagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatcatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaatacattctcattatttatgagaatattttaaagtatataaatatggattcctggaatcgaagccttctagataaatactgtgtagaatatggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcagggaagaggctgacattgtccttggacaggtacattcttgtggatattgatgatatatttgtgggaaaagagggaacaagaatgaacaccaatgatgtaaaggccctgcttgatactcagaatcttttgcgtgcacaaatcacaaattttacattcaacctgggattttcagggaaattttaccatacaggaactgaagaggaagatgaaggagatgactgtctgttggggtctgtggatgagttctggtggtttcctcacatgtggagccatatgcagccccacctcttccacaatgagtcatctttggtggagcagatgattctcaacaaaaaatttgccttagagcacggcattccaacggacatgggctacgctgtggcccctcaccattcgggcgtctaccctgtacatgttcagctttatgaggcctggaagaaggtctggaatattaaaatcaccagcactgaagaatatccacatctgaagccagctagataccggaggggttttatccacaaaaacatcatggttctcccaagacaaacctgtgggcttttcactcacaccattttctacaaagaatatccagggggtcctaaagagctggataagagtatccaaggaggagaacttttcttcactgtcgtcctcaaccctatcagcattttcatgacccatttgtccaactatgggaatgaccgactgggattatatacatttgttaatctggccaactttgtgaagagctggaccaacctgcgacttcagactctgcctccagtacaactggcccacaagtattttgagctgtttcctgatcagaaagaccctctctggcagaatccttgcgatgacaaacgccacagagacatttggtctaaagaaaaaacttgtgatcgcttaccaaaattcttggtaataggaccccagaaaactggtaccactgctttgtatttgttcctggttatgcatccttccatccttagtaactcccccagcccaaaaacctttgaggaggtacagttctttaatagaaataactaccacagggggattgattggtatatggatttcttcccagtcccatctaatgtcactaccgactttttgtttgagaagagtgccaattacttccactcagaggaagcccctaaaagagctgcttctctggttcccaaagccaagattatcaccattctcattgacccttcagaccgagcatactcctggtaccagcatcagcgatcacatgaagaccctgcagctctgaagtttagcttctacgaagtgatctcagcagggccccgtgcaccctcggagctcagagccttgcagaagagatgtttggtcccggggtggtatgccagccacatcgagagatggcttgtttatttccccccatttcagttgctaattattgatgggcaacaactaagaactgatcctgctacagtgatggatgaagtacagaagtttctaggagtcttgcctcattataattactcagaagctttaacgtttgattctcataaaggtttctggtgtcagttactggaagaaggtaaaacaaaatgccttggaaagagcaaaggaagaaaataccctccaatggattctgatagcaggacatttctgtcaagctactatcgagatcacaacgtggaactctcaaagctgctgcacaaactgggtcagcctctgccatcctggctgagacaggagctgcagaaagtaagatagcactgagagaaaacttgagacttcatcgtccatgtagaacacaccttttccaaagcttccagaagctaccaaaaggcagttgaaaaatatacctcttcaaatgagaaaaaagaacagtttcttccatgtgctggcacgtggatgattagaaaaaaagaaaaagtatgtgttacaagccttgaggcctgtggcctttctcttaacccatatctgagcctgtgggattattgtagactactgtgcactcatgtggaagtcaattgcaaccaacataaatatcaaacacaaatgcagaactgttccatttcatagtaatatttacacttttatatatcaactaagattgtgtctctgtaggtttttagaccactgtttgcctgtacgatgttttcttattattttattctataaagtgtcctatgaaacaagaagcaaaataaacatcacaatgtagcataaaatgtcaaaagcataacacccatgaaaaatgcttgccaaaatttaaatccacttaagtatttagaaataattgtaaattataatttgtgctagatcagagtggaaaagttatatatgagtgttatctgcaccaaaaaaaaataagtgctatagcaaaagtgattttttcatatacatagtctagtgaatatatgtaaaaattactaactcttccatcacaacgtaattgttatactgaaatatatactgtaaagctgttggatggtaaatagaaacacatcaagtacaccaaaacagtaaataacaatgtaaagtgtactgactgaatcctctaaaagggagaaattgtaggggtctaaaaacatatcatcgagaattctatgtccacttgctgtaagctgtgaatctatcccagtagtcctcactagttctacagaaatgcatgcctagagtctgaggtatgtgtcatctccagaaacaggttgacttttaaatgtgaatagctatttttaatgctccccaaaacaaaacctattaaactaaaactaaaaacagtttccctagatgatgtggttaggctatttacatttaggttattaaaaaattgcattttcccagatagttcaaaataaaattatgtaatgtagtagagatttataacaaaaaacaaattaatatattatttgtaatctaatgtttgcaatgatacttttgatataaggcaaagaaacataagcagagcagaggcccatttttgaaaatatttcacccatcactctggtggaagtaacagatcataggtacaattaaggattagctactaaattaaatgcaggaagtacaaagatgagcaagtcatgctcttgaaatatatttacatttcaattgtaaataatatatatggttaataaagtttccaaaaaagaaaagaatacatcatacttattttcctgttaatatttacttaatttttttttttgagagggggacagagtctcactatgtcacccaggctggagtgcaatggtgtgatctcagctcactgcaacctccgcctcctgggttcaagtgattctcctgcctcagcctcctgaggagctgggattacagccatgcaccaccacgcccgggtaatttttgtatttttagtagtgacagggtttcaccatgttgactaggctgatcttgaactcctgacctcatgatccacccaccttggcctctcaaagtgctgagattacaagcgtgagccaccatgccctgactacttaatttttaaatgtactgtacatatacataaaatttaagtagtaaattaattccctgctatgattataagcctttataaaatattatcaaaggtatgattagaaacaaatgggaggaaaacccatagtaaaaatattttcattgtcattttaatgggtaaaactatcaattactaattagaaaatgaattgtgagatccacttactataaatttttaactgtacattataattacttttttaaagtttcatgtacctaaagcatatgctaatttttaaatatactattagcagaaaaaattggaaaaatcaccaatttttaagactcttgactctaaaagcaaaatcaaagtgatttggacaaatatgggaaacacagtcttcatgcttactgctgtctcttttatagcagcagatgccagacatgctaggaaaattactatagtcttccatctccaccaacttaagaaaactggcttaggaaggttaaacatgagaataggcctcagcagttatatacagtgtcatgttttcatttggcaacaacatttattctaataaaaaaagaaaagaaaaactgatacatttatgctttaatggtaagatgtacatttgaactgctaagcaaagctgctaatggcctattttgtttaggtaaatcgagttgactgaacacttcatccttttaaatagatgtcaaaaacatactccgtgtttgtataaagacaggagaaaaaggaagagatcttaccaaaatttattcattcacaagtacatgtattacgctagctagagcagcaaacctgtgaaaggatttttgaccactcaatgtgtcttgaagacagcatcaaattctagaggacatgcatactttccacattatatactccaactggttaatatgctaatctgaaagtaacataaatacatatgagagaataatgagagataatctgatttaaaactagctttgtatagaattccctttttcattgtttaaaatatgaaacttcctcaggaagaaatgaaatggttatttcaatgtttatagctgtaatattcttgtcattcacattgaatgaaaattactggaaacatttttttctctgagttttttaaaataaaaaacctagatataattctgatagtagcatggtacctcatatgtacaacaataaactgataggaaaatgaagagtttggacctgg

SEQ ID NO: 13608 - DNA, 3351 bp, Homo sapiens
  ENST00000264363
aaagaccgactacagctaaacaagaggcacagcagcactagcaacagcagagcaggagcagctggtattccggtgattaaatagttctcatagcctttttgctgtactcggtctgctccctggtgtaattctcgtgtccaagaaggaagctgcattttaacggtgtgctgaacagaggtttgaatcattccagctggctgcttgttttgaaaaggacaatgtgtgtataaataaaaggactctgctggaagagttcagacactaagactggagctagagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctagattatgcttagaggattctgcagcaattctcagtattggacatattcaaaatctcctcaacgtatatccttcccatctattgccttccagctttaactcagttgtgctcccttcaaacattttacatgatttgcgatggttacatgaactctggggaagtgatatttgcaacatctcatactttattcactatggcactttaggaaacgaaattgggaaaaagcttccaaaacattattctaaaaaatgaatcttattgtgaaacttcggagaagttttcgaacattgattgttctcttagctaccttttgcttggtgagcattgtcatttctgcctattttctctactctggctacaaacaggaaatgacacttattgaaaccactgcagaagcagaatgcactgacatcaaaattctaccatataggtcaatggagctgaaaacagttaaacctattgacacatccaaaacggaccctactgtccttctcttcgtggagagccaatactctcaactcggtcaagatatcatagctattttggagtccagccgatttcagtaccacatggttattgcccctggaaagggagatatacctcctcttacagataatggcaaagggaaatatactttagttatttatgaaaatattctgaagtatgtcagcatggactcatggaatcgagagcttttagaaaaatactgtgtggaatacagtgttagtataatcggttttcataaagccaatgagaacagcttaccaagtacacaattaaaaggctttccgttaaaccttttcaataatctagctctaaaggactgttttgttaaccctcaatctcctttgctgcatattaccaaagcccccaaggttgagaaaggccctcttcctggggaagactggactattttccaatataatcattcaacctaccagcctgtacttttaactgagttacagacagaaaaatccctgtcatccttgtctagcaaaacactctttgcaacggtgattcaggatctggggcttcatgatggaattcagagagtactttttggcaacaacttgaacttttggctgcacaagctcatcttcatagatgccatctccttcttgtcagggaagaggctgacattgtccttggacaggtacatccttgtggacattgatgatatatttgttgggaaagagggaacaaggatgaatgtcaaagatgtgaaggcattactagagactcaaaatttactgcgcactcaggttgcaaattttaccttcaaccttggattttcagggaagttttaccacacagggactgaagaggaagatgaaggagatgaccttttacttcggtctgtggatgagttctggtggtttcctcacatgtggagccacatgcagccccacctcttccacaacgagtcatctttagtagagcagatgattctcaacaaggaatttgcactggaacatggaataccaatcaacatgggctatgctgtggccccacatcactcaggggtctacccggttcacattcagctgtatgcagcttggaagaaggtctggggtattcaagtcaccagcactgaagaatatccacatctgaaacctgcccggtacagaaagggcttcattcacaatagcatcatggtcctccctcgacagacttgtgggttgttcactcacactattttctacaaagaatatccaggaggaccccaagaactggataaaagtatcagaggaggtgaactttttctcacaatccttctaaacccaatcagcattttcatgacccatttatcaaactatggaaatgaccgcctagggttatatacctttgtgaacttggtcaactttgtgcagagctggaccaacctgaaattgcaaactctgcctccagtgcaactggcccaccagtattttgagctcttccctgagcagaaagaccctctatggcagaatccatgtgatgataaacgacacaaagacatctggtccagagagaaaacttgtgaccacttaccaaaatttctagtaattggtccacaaaaaacaggaacaactgcactttatttatttcttcttatgcatccttcaatcatcagcaatctccctagtccaaagacatttgaggaagttcagttctttaatggcaacaactatcacaaaggaatagactggtatatggactttttccctacaccatccaatactacaagtgactttctgtttgaaaagagtgctaattacttccattcggaagaagctccaagacgagccgcatctcttgtccccaaagccaagatcatcaccatcctcattgacccctcagacagggcatactcttggtaccagcaccaacgatcacatgaagatccagctgctctgaggttcaatttctatgaagttatttcaacaggacattgggctccatctgacttaaaaactttgcagagaagatgcctagtacctggatggtatgcagtccacatagaaagatggctaacttactttgctacttctcagttgctaattattgatggacagcagctgagatctgacccagctactgtgatggatgaagtccagaagtttctgggagttacacctcgttataattactctgaagcactaacgtttgatccccaaaagggtttttggtgtcaattactggaaggaggaaagacaaaatgccttggaaaaagcaaaggccgaaaatatccacctatggatccagagtctagaacgttcctctctaattactaccgagatcataatgtggaactatccaaactgctacacagactgggacagcctctgccatcgtggctgagacaggaactgcagaaagtgagatagcactggagacaagaactaagcctctcaagatacttttagtgttaaaaaaaaaa

SEQ ID NO: 13609 - DNA, 2015 bp, Homo sapiens
  ENST00000504854
tgctgtactcggtctgctccctggtgtaattctcgtgtccaagaaggaagctgcattttaacggtgtgctgaacagaggtttgaatcattccagctggctgcttgttttgaaaaggacaatgtgtgtataaataaaaggactctgctggaagagttcagacactaagactggagctagagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctagggactgaagaggaagatgaaggagatgaccttttacttcggtctgtggatgagttctggtggtttcctcacatgtggagccacatgcagccccacctcttccacaacgagtcatctttagtagagcagatgattctcaacaaggaatttgcactggaacatggaataccaatcaacatgggctatgctgtggccccacatcactcaggggtctacccggttcacattcagctgtatgcagcttggaagaaggtctggggtattcaagtcaccagcactgaagaatatccacatctgaaacctgcccggtacagaaagggcttcattcacaatagcatcatggtcctccctcgacagacttgtgggttgttcactcacactattttctacaaagaatatccaggaggaccccaagaactggataaaagtatcagaggaggtgaactttttctcacaatccttctaaacccaatcagcattttcatgacccatttatcaaactatggaaatgaccgcctagggttatatacctttgtgaacttggtcaactttgtgcagagctggaccaacctgaaattgcaaactctgcctccagtgcaactggcccaccagtattttgagctcttccctgagcagaaagaccctctatggcagaatccatgtgatgataaacgacacaaagacatctggtccagagagaaaacttgtgaccacttaccaaaatttctagtaattggtccacaaaaaacaggaacaactgcactttatttatttcttcttatgcatccttcaatcatcagcaatctccctagtccaaagacatttgaggaagttcagttctttaatggcaacaactatcacaaaggaatagactggtatatggactttttccctacaccatccaatactacaagtgactttctgtttgaaaagagtgctaattacttccattcggaagaagctccaagacgagccgcatctcttgtccccaaagccaagatcatcaccatcctcattgacccctcagacagggcatactcttggtaccaggttggagtgcaatggcgtgatctcggctcactgcaaccttcacctcccaggttcatgccattctcctgcctcagcctcctgagtagctgggactacagcaccaacgatcacatgaagatccagctgctctgaggttcaatttctatgaagttatttcaacaggacattgggctccatctgacttaaaaactttgcagagaagatgcctagtacctggatggtatgcagtccacatagaaagatggctaacttactttgctacttctcagttgctaattattgatggacagcagctgagatctgacccagctactgtgatggatgaagtccagaagtttctgggagttacacctcgttataattactctgaagcactaacgtttgatccccaaaagggtttttggtgtcaattactggaaggaggaaagacaaaatgccttggaaaaagcaaaggccgaaaatatccacctatggatccagagtctagaacgttcctctctaattactaccgagatcataatgtggaactatccaaactgctacacagactgggacagcctctgccatcgtggctgagacaggaactgcagaaagtgagatagcactggagacaagaactaagcctctcaaga

SEQ ID NO: 13610 - DNA, 1234 bp, Homo sapiens
  ENST00000514570
cacagcagcactagcaacagcagagcaggagcagctggtattccggtgattaaatagttctcatagcctttttgctgtactcggtctgctccctggtgtaattctcgtgtccaagaaggaagctgcattttaacggtgtgctgaacagaggtttgaatcattccagctggctgcttgttttgaaaaggacaatgtgtgtataaataaaaggactctgctggaagagttcagacactaagactggagctagagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctaggcattactagagactcaaaatttactgcgcactcaggttgcaaattttaccttcaaccttggattttcagggaagttttaccacacagggactgaagaggaagatgaaggagatgaccttttacttcggtctgtggatgagttctggtggtttcctcacatgtggagccacatgcagccccacctcttccacaacgagtcatctttagtagagcagatgattctcaacaaggaatttgcactgagatgcggagaggagaaatgccgtggactgccatttccaaggagaaatcataagcctagacttgacactacagagagatgtagccctatgttcttggctacacttacccaaggaacatggaataccaatcaacatgggctatgctgtggccccacatcactcaggggtctacccggttcacattcagctgtatgcagcttggaagaaggtctggggtattcaagtcaccagcactgaagaatatccacatctgaaacctgcccggtacagaaagggcttcattcacaatagcatcatggtcctccctcgacagacttgtgggttgttcactcacactattttctacaaagaatatccaggaggaccccaagaactggataaaagtatcagaggaggtgaactttttctcacaatccttctaaacccagtatgtattctatgtatgcaccttacaataagattagcatttttaaatgtgttttattttcctgtcttttaaactaaatcatatttattttctttatttacagcacatcttactggtcatgcatttaaatctatattaaaatacttttcttgataaaa

SEQ ID NO: 13611 - DNA, 3439 bp, Homo sapiens
  ENST00000613194
aaagaccgactacagctaaacaagaggcacagcagcactagcaacagcagagcaggagcagctggtattccggtgattaaatagttctcatagcctttttgctgtactcggtctgctccctggtgtaattctcgtgtccaagaaggaagctgcattttaacggtgtgctgaacagaggtttgaatcattccagctggctgcttgttttgaaaaggacaatgtgtgtataaataaaaggactctgctggaagagttcagacactaagactggagctagagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctagattatgcttagaggattctgcagcaattctcagtattggacatattcaaaatctcctcaacgtatatccttcccatctattgccttccagctttaactcagttgtgctcccttcaaacattttacatgatttgcgatggttacatgaactctggggaagtgatatttgcaacatctcatactttattcactatggcactttaggaaacgaaattgggaaaaagcttccaaaacattattctaaaaaatgaatcttattgtgaaacttcggagaagttttcgaacattgattgttctcttagctaccttttgcttggtgagcattgtcatttctgcctattttctctactctggctacaaacaggaaatgacacttattgaaaccactgcagaagcagaatgcactgacatcaaaattctaccatataggtcaatggagctgaaaacagttaaacctattgacacatccaaaacggaccctactgtccttctcttcgtggagagccaatactctcaactcggtcaagatatcatagctattttggagtccagccgatttcagtaccacatggttattgcccctggaaagggagatatacctcctcttacagataatggcaaagggaaatatactttagttatttatgaaaatattctgaagtatgtcagcatggactcatggaatcgagagcttttagaaaaatactgtgtggaatacagtgttagtataatcggttttcataaagccaatgagaacagcttaccaagtacacaattaaaaggctttccgttaaaccttttcaataatctagctctaaaggactgttttgttaaccctcaatctcctttgctgcatattaccaaagcccccaaggttgagaaaggccctcttcctggggaagactggactattttccaatataatcattcaacctaccagcctgtacttttaactgagttacagacagaaaaatccctgtcatccttgtctagcaaaacactctttgcaacggtgattcaggatctggggcttcatgatggaattcagagagtactttttggcaacaacttgaacttttggctgcacaagctcatcttcatagatgccatctccttcttgtcagggaagaggctgacattgtccttggacaggtacatccttgtggacattgatgatatatttgttgggaaagagggaacaaggatgaatgtcaaagatgtgaaggcattactagagactcaaaatttactgcgcactcaggttgcaaattttaccttcaaccttggattttcagggaagttttaccacacagggactgaagaggaagatgaaggagatgaccttttacttcggtctgtggatgagttctggtggtttcctcacatgtggagccacatgcagccccacctcttccacaacgagtcatctttagtagagcagatgattctcaacaaggaatttgcactggaacatggaataccaatcaacatgggctatgctgtggccccacatcactcaggggtctacccggttcacattcagctgtatgcagcttggaagaaggtctggggtattcaagtcaccagcactgaagaatatccacatctgaaacctgcccggtacagaaagggcttcattcacaatagcatcatggtcctccctcgacagacttgtgggttgttcactcacactattttctacaaagaatatccaggaggaccccaagaactggataaaagtatcagaggaggtgaactttttctcacaatccttctaaacccaatcagcattttcatgacccatttatcaaactatggaaatgaccgcctagggttatatacctttgtgaacttggtcaactttgtgcagagctggaccaacctgaaattgcaaactctgcctccagtgcaactggcccaccagtattttgagctcttccctgagcagaaagaccctctatggcagaatccatgtgatgataaacgacacaaagacatctggtccagagagaaaacttgtgaccacttaccaaaatttctagtaattggtccacaaaaaacaggaacaactgcactttatttatttcttcttatgcatccttcaatcatcagcaatctccctagtccaaagacatttgaggaagttcagttctttaatggcaacaactatcacaaaggaatagactggtatatggactttttccctacaccatccaatactacaagtgactttctgtttgaaaagagtgctaattacttccattcggaagaagctccaagacgagccgcatctcttgtccccaaagccaagatcatcaccatcctcattgacccctcagacagggcatactcttggtaccaggttggagtgcaatggcgtgatctcggctcactgcaaccttcacctcccaggttcatgccattctcctgcctcagcctcctgagtagctgggactacagcaccaacgatcacatgaagatccagctgctctgaggttcaatttctatgaagttatttcaacaggacattgggctccatctgacttaaaaactttgcagagaagatgcctagtacctggatggtatgcagtccacatagaaagatggctaacttactttgctacttctcagttgctaattattgatggacagcagctgagatctgacccagctactgtgatggatgaagtccagaagtttctgggagttacacctcgttataattactctgaagcactaacgtttgatccccaaaagggtttttggtgtcaattactggaaggaggaaagacaaaatgccttggaaaaagcaaaggccgaaaatatccacctatggatccagagtctagaacgttcctctctaattactaccgagatcataatgtggaactatccaaactgctacacagactgggacagcctctgccatcgtggctgagacaggaactgcagaaagtgagatagcactggagacaagaactaagcctctcaagatacttttagtgtt

SEQ ID NO: 13612 - DNA, 1811 bp, Homo sapiens
  ENST00000499732
gcaaaagttgtggcaagtccagccggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttca

SEQ ID NO: 13613 - DNA, 22743 bp, Homo sapiens
  ENST00000501122
ggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaaa

SEQ ID NO: 13614 - DNA, 487 bp, Homo sapiens
  ENST00000601801
agttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaagaccaagggctgtgaacccgcctggggatgaggcctggtcttgtggaactgaacttagctcgacggggctgaccg

SEQ ID NO: 13615 - DNA, 572 bp, Homo sapiens
  ENST00000612303
ttttttccagaccaagggctgtgaacccgcctggggatgaggcctggtcttgtggaactgaacttagctcgacggggctgaccgctctggcccagggtggtggcagtgctccttttggacttttctctagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgt

SEQ ID NO: 13616 - DNA, 483 bp, Homo sapiens
  ENST00000616315
ctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaa

SEQ ID NO: 13617 - DNA, 5289 bp, Homo sapiens
  ENST00000417640
aggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggagggggggacaccgagcgcggagagcgcggagagcgcggagggaggcgcgcgcgggagcgaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaataatcttgacacagaagagctatgtgaatatttttctcagcacttgggcgagtatgagaatgtactagcagcacttgaagacctgaatctttccatcctgaaggcaatgggcaaaacaaagaaagactaccaagaagcctccaatttggaacaattcgtaactagatttttattgaaggaaaccctgaatcagctgcagtctctccagaattccctggaatgtgccatggaaactactgaggagcaaacccgtcaagaaaggcaagggccagccaagccagaagtcctgtcgattcaatggcctggaaaacgatcaagccgccgagtccagagacacaacagcttctccccaaacagccctcagtttaatgtcagcggtccaggcttattagaagaagacaaccagtggatgacccagataaatagactccagaaattaattgatagactggaaaagaaggatctcaaactcgaaccaccagaagaagaaattattgaagggaatactaaatctcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatgtctactccatccccaacccaactcacagccctatgactactatctttgcattagttaaaaagttagtatataggcatcaaacaaccttggctgtaacctatagaatctctatccacgtatcaggttatagactggtttttcaaaagtgaacaatcctgtgataagttggagtaccatttagtaatacagcaacattgtgtcatttattagcatcataattctttgttatgtaagttaaatatatcaagaaagaagagactgtttggaaaaatgtggttcaagttttatgctatatagttttggtatgcgatacagacagctaacttttcttatgaaaaatacatatttgcatgtaaacaatgatttcaaaatacttgaaaaataaaattttaacccaaatgaataactaagaaatataaaacaagcacaaaatcttagggaagtcataaaatagtagtgaaagtattagacagaagacatctgttttcgaatttcaacactagaatgactaaaactatctacctatagaactatctgtagatagtatactatctacactctgctcaacaagctcagaaattaaatatttttaataataaaaatctgttctggttataaaccttgctaatgaaaatacaatacatataaaaatgtatagccatgttattttctagtataaattcctttgaaactataagtctttgaggaaaattataaggtaaaattttcctgtttttccccctttgaaaaactcaggaaaaaaggaagattgaactaataaaattttatttcttaaatataaatttgacctaaaatattttctcaaactaattcatgaaacagcaacttttaccaatacctttgtatactctcagttctcattcagtataaataaaattttaaaatcctttcatagttctattagaaataagtagtaaattttgatatattgtacatacacacgtgtgtgtgtgtgtgtgtgtgtgtgtgtgtgtgtgtgtgtgtatttgtgtgcctctggtcaactctaaggatgacagacactgtgtaacaacacctgggtcaactcttttaatttatatacaaagcaaagaacaacattaatggagatgcacaatgattattcaaacaagctatatatatgtacaaaggcaaacagacacataacagtctctgcagactgattgtatatagtaagaaaagatcaaaagactttaaaacctaaatgacttttgacatacaaactcttcttgagaatgtttgttgtaaatggtttcaaaaatacaaattatagccaatcaaaacattgctttggttggtgcatttaagtatccaactcaaaaagcatatcaaatattttgggtactaggcagtttccaaagtagcatggtagtattacttgttaaaagggttctgttttcattaacagtactaagtggaagggatctgcagattccaaactggaataagctctatcatattctgaaacaagaattagaatgacttgagaacgggcaaataacaaagcaaaccaatataattatatggtcattctgaccccagctcttatacaaattatacatgtatttttgtgtatgtttgtgagagttgtatgtatgtgaatgtgtgtgagtgtgtattcacatacacatatatactggaacctatagtagaaaaggaaactagtagggccaaaaaaaaaaagaaaaagaaaaagaaaaaagaaaaaaaaagaaaaaactgggacctaagtataaatatctcatcctaaagtaaacaataagtttatagttaacgaagatttttttctatttaaaaccccattttcctaaagaacaaagtagtaaaataaaaaaaaatttaaaaaattaaaaaataaaaaaaagaggtcactaaaagaccaagatgggaaacgtaacatggaatacaagcttgaatctgggaaacaagctcaaaaaacagtgaaaaaaaaagtactggtttaggagttcaaaattcagtgaaacaaactttttgccaatagacctagggatctaagaaatagaattagggagagtttacacttacttacctatatatcagcagatttttctggaagaaaccctttttttttttttttttaaacagtaacatccagagtgacaaattgcaggagatttaatgtataaaatttctaggaattaaaagcttaaacccaaaaattgttcatccatatataagaaattatcgaattaaaacttaatgtatgtcaattattttcaaatgtctaaattcctttggaaataaaaatatcagttttactttgaaattgctcaacttctgctattcatatggtctgattagtgacataagtagcagccgtttttcaacttcagtttcattcactaccattgtttccaaattatcaatctctgctagtaattatgaatttaagaccatattattatcaaaaacctagagaccaatcatatatctgaaaagaaatacccattaaaaattctgcctcctgtttattgagaactatgcattgaacattctgaatcattctaagcctctggagagactgtaatgatccattcatgagctggtatgaaatcagtgggaagcagaacaacagaaggaactttaaaagcaacaagcaattatgtaccatatatacactgtagcaaatattttatatttgagagtctttacagcttacatttccattccattattacaagtgatgaaaaacaaaaaattgcaagtagtatgcaaattataaatatacagtcttcccacttcactaaccaaattcctactttccagtgttacttcccaatttatgcaggaaacctcctgcaaagctgaaactgattagaaaattctttatattttaaaatagctctttctcatttttagagaagtcaaatagccaaccatcaaaattaagaataaattgaattgtcacagtccattacagttattgttgctagatccacctcatttgcagatgtccaaacttaaattcatctgttcttaaaatgctacttaaaactttggttgttttcctgtaatataaaagaaaaagttaatttatcaattgattgaatacagtttttactaattagtttatcaaaccaaatactgtgaacgtaccaggtgtttacagatttaaatgcatgttaccatagaaactattaaagtaactagaactgtcaaataacaaaacggctcatgtttttaaaatatatgtaactcattttaaaatatattaaattgtattccaaacctgttcttctgtttctgtggcacctaggtttaaaatatgtattaatgtgtaaatcacaagtaaaatgaattctaatgtacaagtttgttttaaaaagtgtatgtcaagcttttatttacacaataaaatgttattaaagatggaaagtctacaaatg

SEQ ID NO: 13618 - DNA, 656 bp, Homo sapiens
  ENST00000522729
agcgcggagggaggcgcgcgcgggagcgaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaagtaagaaacttttttatcactggattccacaagtgaggcacagagagcgtgaatgcattcatgtccaggaagaagaaagggaagaacaatatagagggtatattttgccaagtttgcctatgcttaattctgagatacctctttagtaattaaaattgctctgaaaaattgactttgaatcagaaaataatgatcttttgtagaaagctcccctgaagtgtttttagattgttcccactttgcagaatgtaaaacaaagtataaattataaataaat

SEQ ID NO: 13619 - DNA, 662 bp, Homo sapiens
  ENST00000523962
agctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaataatcttgacacagaagagctatgtggtaagtgtttctttaagatcagtcaaacctattacttgcttaagaaggaaaaagagtattgtctgatatatatcaaccttggaattaatgttgtatattaggagttcacaaaggaaaaattaatcgagatctcaagggatttatctttacccgtgaattttgctcaagtatgtatttcactccagaaagagttgggcctcattagttcgttcatagaagaagaattgttgttacaatcagtacattagtttcgcaagagcaaattctccacaagtttgaatatatttttaaattgatgtttaatacaacttcattattctctgcat

SEQ ID NO: 13620 - DNA, 490 bp, Homo sapiens
  ENST00000521954
agctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaataatcttgacacagaagagctatgtgaatatttttctcagcacttgggcgagtatgagaatgtactagcagcacttgaagacctgaatctttccatcctgaaggcaatgggcaaaacaaagaaattttgaagactttcagcactggggcaagagaaagcgtagccaccagcaccccgcaa

SEQ ID NO: 13621 - DNA, 811 bp, Homo sapiens
  ENST00000522820
atttgaacagggcctgttgtaagtagttaatgtgtttgacaaccctgtaatatttgatatacctttggaaatgcatgagttactaatttttttgaaatctagttgtttgtaatgattgtcacttatgtctaatatcacaaaatattcaagaaattggagctgtgcaatgaacaataggacttctctttaaaaattgcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataat

SEQ ID NO: 13622 - DNA, 2908 bp, Homo sapiens
  ENST00000521366
attgagaatcactgcttttaaagggaaacacgtcattgtaaagaacacgttgtttagcttctgggactagaggcaaggaaaatatcttgcctagattacagcctttatacagttttatacttggaatagtcatggccttccttggtcatatttttggatgacaatcatctgtttttgtgaggaggaatgggatgggcagtaggagtcagcttaaatcgggctccgtgacagccaacgcagtgaccctcgccccttccttggcagcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatgtctactccatccccaacccaactcacagccctatgactactatctttgcattagttaaaaagttagtatataggcatcaaacaaccttggctgtaacctatagaatctctatccacgtatcaggttatagactggtttttcaaaagtgaacaatcctgtgataagttggagtaccatttagtaatacagcaacattgtgtcatttattagcatcataattctttgttatgtaagttaaatatatcaagaaagaagagactgtttggaaaaatgtggttcaagttttatgctatatagttttggtatgcgatacagacagctaacttttcttatgaaaaatacatatttgcatgtaaacaatgatttcaaaatacttgaaaaataaaattttaacccaaatgaataactaagaaatataaaacaagcacaaaatcttagggaagtcataaaatagtagtgaaagtattagacagaagacatctgttttcgaatttcaacactagaatgactaaaactatctacctatagaactatctgtagatagtatactatctacactctgctcaacaagctcagaaattaaatatttttaataataaaaatctgttctggttataaaccttgctaatgaaaatacaatacatataaaaatgtatagccatgttattttctagtataaattcctttgaaactataagtctttgaggaaaattataaggtaaaattttcctgtttttccccctttgaaaaactcaggaaaaaaggaagattgaactaataaaattttatttcttaaatataaatttgacctaaaatattttctcaaactaattcatgaaacagcaacttttaccaatacctttgtatactctcagttctcattcagtataaataaaattttaaaatcctttcatagttctattagaaataagtagtaaattttgatatattgtacatacacacgtgtgtgtgtgtgtgtgtgtgtgtgtgtgtgtgtgtgtgtgtatttgtgtgcctctggtcaactctaaggatgacagacactgtgtaacaacacctgggtcaactcttttaatttatatacaaagcaaagaacaacattaatggagatgcacaatgattattcaaacaagctatatatatgtacaaaggcaaacagacacataacagtctctgcagactgattgtatatagtaagaaaagatcaaaagactttaaaacctaaatgacttttgacatacaaactcttcttgagaatgtttgttgtaaatggtttcaaaaatacaaattatagccaatcaaaacattgctttggttggtgcatttaagtatccaactcaaaaagcatatcaaatattttgggtactaggcagtttccaaagtagcatggtagtattacttgttaaaagggttctgttttcattaacagtactaagtggaagggatctgcagattccaaactggaataagctctatcatattctgaaacaagaattagaatgacttgagaacgggcaaataacaaagcaaaccaatataattatatggtcattctgaccccagctcttatacaaattatacatgtatttttgtgtatgtttgtgagagttgtatgtatgtgaatgtgtgtgagtgtgtattcacatacacatatatactggaacctatagtagaaaaggaaactagtagggccaaaaaaaaaaagaaaaagaaaaagaaaaaagaaaaaaaaagaaaaaactgggacctaagtataaatatctcatcctaaagtaaacaataagtttatagttaacgaagatttttttctatttaaaaccccattttcctaaagaacaaagtagtaaaataaaaaaaaatttaaaaa

SEQ ID NO: 13623 - DNA, 564 bp, Homo sapiens
  ENST00000491525
atcatcaggggatctcccggagcgatgcaggacaaggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagcc

SEQ ID NO: 13624 - DNA, 586 bp, Homo sapiens
  ENST00000461477
ataagtgcatcttgagaataggtgatagaaagccttggctgcaggagacaagcttacaggggacgacagaggcagacaggcacagggagggagggaagaggaaagggctggagggaaaaaggcactagaccgagcgctgggagactggaagggaggcagaagttaagaaagaaaaaagaggtgggcagggtgtagaatggcttgtagccttggaggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaaggg

SEQ ID NO: 13625 - DNA, 3664 bp, Homo sapiens
  ENST00000485303
agttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttattataaggctgtagtatcaggttaaggatacagataaataaagttcacttatatcttcttacaaa

SEQ ID NO: 13626 - DNA, 1549 bp, Homo sapiens
  ENST00000319792
ggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaa

SEQ ID NO: 13627 - DNA, 732 bp, Homo sapiens
  ENST00000486596
ggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattccct

SEQ ID NO: 13628 - DNA, 1876 bp, Homo sapiens
  ENST00000493615
aggctctgtggtaggtgaacctcggcggccggcgtgggctgagggagccgccactgagggtgcgggcgccgcggccggctctgccagccgttctctggagcagcgaggcggttggttgtgcgagcgagtgccgaggactttggctggaaacttttcgccgcgcccggggcgaggccctggaagggccaggccagcgaatgctgagccggcggcccgctgccctcccccgcggccgcgcgggtcgccgtgcggatggccgagggttggcgatggtgcttcgtgcgccgaactccgggtttgctccggggaccgttacttcctcgctcattctctgggaaccctcgtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatgttccatttaagcagacctcttccatagctgtagctggagcggtaattggagctgttcttgcccttttcatcattgctatctttgtgactgtgctgctgactcctcgaaaaaaaagaccatcctatcttgacaaagtgattgaccttccacccacacataaaccacctcctctgtatgaagaacgatccccacctttgcctcagaaagacctatttcagcctgaacacttgcctttgcagactcagttcaaagaaagagaagttggcaatcttcagcactctaatggactaaatagcaggagttttgactatgaagatgagaatccagttggggaagatggcattcagcagatgtaccccctttacaatcaaatgtgctaccaagaccggagccctggcaaacatcatcaaaataacgaccctaagagagtctacatcgacccacgagaacattatgtgtgatttttctctttttccaatgggcgttctaacaaatgtttattcttagattggggagagaagctaaggccaatagttattttactgtctctcatataagaacagtcccactctaagggtattggaagtcttaatgaatgacgtaaagccaatagcaaatttc

SEQ ID NO: 13629 - DNA, 829 bp, Homo sapiens
  ENST00000488016
attctctgggaaccctcgtaggttaaggtgccgggatgcacgtttgccgctttttttcccggtgaaacttgagctgtgagcccagaaaccctagggaccggagcccgatggaatgaagcctccgggtccacttctcatggccttccaccctggagaaggcaccattttagcccacccagccgcagaatcccctacagctagttttcttctgtcttgtgcccactcccccggctctgccctgacagcttctggagctctctagattgaccctcgtccctgccctccagcttgtgggacgtctctcacactgcccgtgcttattttaccaaaccgcaggaacaagatttacgtgttaaatacctgatttcatggactgtgtgccccggctgttctaaccaaaacagtcacgcgcctgtttcccatctcttgaccctcgtgttatgttactgttttcctgtcatatttgggagttagtctctgagttttcttcccaggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaact

SEQ ID NO: 13630 - DNA, 554 bp, Homo sapiens
  ENST00000470618
tgagaatttccactgacagtttaccaccacgtttccagcactgtaatgaaatctgatttacacagagtatagtatggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaat

SEQ ID NO: 13631 - DNA, 530 bp, Homo sapiens
  ENST00000481766
ttgtgacttatggaagcttagtggtatggaagcaaaattttcttcaatatggcatccaggagattgtttttcttgcaagactattgactgcccaccattcattctgctaaataagttgagtagggaagacctgttgcattgtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatg

SEQ ID NO: 13632 - DNA, 549 bp, Homo sapiens
  ENST00000478327
agagaatattatcatgggtatggtaatgatgaataacaagatagactgacctttgtaaggtcccatttggctctgagattctatgcctctttccattttcagcaaggcttcatcttaagatgaatgtttaaaagagcacagaaaagaagatctgatatgatatggaacttttaaaagcactttgactacttgataggcacttggggacataacacacgcataagacagagtcctggcttcaagatgcttgtaactttgggttcgacctaaaggaaacatgattgtagaacagtttggtgtttgtgaggtattttgatttgcccggaaatgggacacctaacccattagtatggcatccaggagattgtttttcttgcaagactattgactgcccaccattcattctgctaaataagttgagtagggaagacctgttgcatttacttttttttcctccataggtgccttagctggaccaattattgtggagccacatgtcacagcagtatggggaaagaatgtttcattaaagtgtttaattgaagtaaa

SEQ ID NO: 13633 - DNA, 314 bp, Homo sapiens
  ENST00000485506
cctgaacacttgcctttgcagactcagttcaaagaaagagaagttggcaatcttcagcactctacttactataatcctgggacaaaaacacattaagaggaagatggatcaatagttctcaaaggaaaaagatggcagcaacctataagaagatctgagcttctaggaatgatgggctattttttctatttttcagagacttttatagcttataaatacttatcagaagaaattagttccacagaatgacagtgaagttgtgatcacatcccaccaaattgtaattttatatccccttccttcaccaaggttaa

SEQ ID NO: 13634 - DNA, 5707 bp, Homo sapiens
  ENST00000508871
caaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 13635 - DNA, 6339 bp, Homo sapiens
  ENST00000503468
tatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttacttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 13636 - DNA, 7019 bp, Homo sapiens
  ENST00000338963
gctgcagctgagctcagcttaaaggtcgctggaaatcaagtgctttgtaagtgaaggcattttgactacaagcgattcaagacattttggaaacgtcagtctctggaatgggtcgtctttttctttctatgatatctggtatctaatgttttacttaggataaagactactacttaatagctcttttaggcaccacaaatgattttttcttttgatgcagtgcagctgcttctagcctgtctacggacagagatctttgttatgactttcagcccttaacatgtttggaaatgagaacaaatggcacaaagcttacgattgcactttgcagccagaagaagcaatacttaccctttgtcagaaacctccggagatgacttggatagccatgttcacatgtgcttcaaaagaccaacacggatttcaacgtctaacgttgttcaaatgaagctgactcccagacagactgcactagctccgttaataaaggaaaacgttcagtctcaagaaagatcatctgttccctcatctgaaaatgttaataaaaagagcagctgtctacagatttcactacagccaacaaggtacagtggatatcttcagtctagcaatgtcttagctgatagtgatgatgcttcgtttacttgtatcttgaaggatggtatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 13637 - DNA, 7235 bp, Homo sapiens
  ENST00000508342
gctgcagctgagctcagcttaaaggtcgctggaaatcaagtgctttgtaagtgaaggcattttgactacaagcgattcaagacattttggaaacgtcagtctctggaatgggtcgtctttttctttctatgatatctggtatctaatgttttacttaggataaagactactacttaatagctcttttaggcaccacaaatgattttttcttttgatgcagtgcagctgcttctagcctgtctacggacagagatctttgttatgactttcagcccttaacatgtttggaaatgagaacaaatggcacaaagcttacgattgcactttgcagccagaagaagcaatacttaccctttgtcagaaacctccggagatgacttggatagccatgttcacatgtgcttcaaaagaccaacacggatttcaacgtctaacgttgttcaaatgaagctgactcccagacagactgcactagctccgttaataaaggaaaacgttcagtctcaagaaagatcatctgttccctcatctgaaaatgttaataaaaagagcagctgtctacagatttcactacagccaacaaggtacagtggatatcttcagtctagcaatgtcttagctgatagtgatgatgcttcgtttacttgtatcttgaaggatggtatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 13638 - DNA, 5869 bp, Homo sapiens
  ENST00000435532
ggccttttcccgccgcgctgccgggtgccgctagtgcccgctcgccgcgggaggcgctgctgtcgctgagggagcgcctcctcctcttcctccaactcttccccgcctcctcccgcttctcctcctcctcctccacagttgcctgccctgggcgggggcgagcgcgtccggtttgctggaagcgttcggaaatggcaacttgcgcggtggaggtgttcgggctcctggaggacgaggaaaattcacgaattgtgagagtaagagttatagccggaataggccttgccaagaaggatatattgggagctagtgatccttacgtgagagtgacgttatatgacccaatgaatggagttcttacaagtgtgcaaacaaaaaccattaaaaagagtttgaatccaaagtggaatgaagaaatattattcagagttcatcctcagcagcaccggcttctttttgaagtgtttgacgaaaaccgattgacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 13639 - DNA, 6751 bp, Homo sapiens
  ENST00000506154
ggtcgctggaaatcaagtgctttgtaagtgaaggcattttgactacaagcgattcaagacattttggaaacgtcagtctctggaatgggtcgtctttttctttctatgatatctggtatctaatgttttacttaggataaagactactacttaatagctcttttaggcaccacaaatgattttttcttttgatgcagtgcagctgcttctagcctgtctacggacagagatctttgttatgactttcagcccttaacatgtttggaaatgagaacaaatggcacaaagcttacgattgcactttgcagccagaagaagcaatacttaccctttgtcagaaacctccggagatgacttggatagccatgttcacatgtgcttcaaaagaccaacacggatttcaacgtctaacgttgttcaaatgaagctgactcccagacagactgcactagctccgttaataaaggaaaacgttcagtctcaagaaagatcatctgttccctcatctgaaaatgttaataaaaagagcagctgtctacagatttcactacagccaacaaggtacagtggatatcttcagtctagcaatgtcttagctgatagtgatgatgcttcgtttacttgtatcttgaaggatggtatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatccc

SEQ ID NO: 13640 - DNA, 652 bp, Homo sapiens
  ENST00000502612
cttgcgcggtggaggtgttcgggctcctggaggacgaggaaaattcacgaattgtgagagtaagagttatagccggaataggccttgccaagaaggatatattgggagctagagtttgaatccaaagtggaatgaagaaatattattcagagttcatcctcagcagcaccggcttctttttgaagtgtttgacgaaaaccgattgacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccacc

SEQ ID NO: 13641 - DNA, 577 bp, Homo sapiens
  ENST00000514893
gagaacagatgacgcaaggctccaaagttcagagaactgaacaagggggatgagactcaaaacaagaggactcctgactcactaggttagggtgatccttacgtgagagtgacgttatatgacccaatgaatggagttcttacaagtgtgcaaacaaaaaccattaaaaagagtttgaatccaaagtggaatgaagaaatattattcagagttcatcctcagcagcaccggcttctttttgaagtgtttgacgaaaaccgattgacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcagg

SEQ ID NO: 13642 - DNA, 457 bp, Homo sapiens
  ENST00000507063
gtggaatgaagaaatattattcagagttcatcctcagcagcaccggcttctttttgaagtgtttgacgaaaaccgattgccatggttagtgacaaatcaggagtgaaggtgattcctttatataagttctgcaactgagtgaattccagacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagag

SEQ ID NO: 13643 - DNA, 591 bp, Homo sapiens
  ENST00000513957
gaaaattcacgaattgtgagagtaagagttatagccggaataggccttgccaagaaggatatattgggagctagtgatccttacgtgagagtgacgttatatgacccaatgaatggagttcttacaagtgtgcaaacaaaaaccattaaaaagagtttgaatccaaagtggaatgaagaaatattattcagaaaaataattctggaaggacctaagaaactgtttactgtatttgctctgggggtgggacaaaggttcatcctcagcagcaccggcttctttttgaagtgtttgacgaaaaccgattggtaagttatattgtgcttatatgaaatatgaagtaagggtacatttcagtggagcagccaggggaagtgggtaagcagtctgggatttgagtgatggcttgggggtggttatggagactctgggcaaaatggtgagggagatagaatttgttttcttcctcctggtcctactcgctccctttccattctcctcccaagcacctcttctgattgccaacatattataaggtcttactcaagacctcttgtgacaggagaggacagaaaaccaacctctttgtcc

SEQ ID NO: 13644 - DNA, 965 bp, Homo sapiens
  ENST00000508075
gccctgggcgggggcgagcgcgtccggtttgctggaagcgttcggaaatggcaacttgcgcggtggaggtgttcgggctcctggaggacgaggtaggccctgctaattgcagatttctcatctcaccgccttccagcagagccagttgatcttaaagaaaatagtgccaaagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagaga

SEQ ID NO: 13645 - DNA, 374 bp, Homo sapiens
  ENST00000557845
cacagttgcctgccctgggcgggggcgagcgcgtccggtttgctggaagcgttcggaaatggcaacttgcgcggtggaggtgttcgggctcctggaggacgagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaagga

SEQ ID NO: 13646 - DNA, 3335 bp, Homo sapiens
  ENST00000356462
gcgccgccgccgcgcgcagtgagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatccttt

SEQ ID NO: 13647 - DNA, 3647 bp, Homo sapiens
  ENST00000400345
gcgcgcagtgagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaa

SEQ ID NO: 13648 - DNA, 1033 bp, Homo sapiens
  ENST00000589054
agtgagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaa

SEQ ID NO: 13649 - DNA, 728 bp, Homo sapiens
  ENST00000617539
gagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagcccgggagtccatgatgcatgtcacgtctgggtcgcgcggctggagacccgggactgcggagaagccggatcgtttccccctggaactttctctctcatgattgtgtggatcagcaggcgctcagaagcctgtgcgtgcttatcccggcgggaatgggggacacgctgcgtgtgtccctcccctcgttttgcaaagtctacggccaggattgtggatttcggagcctcggtgggggaggtgttcaaggctggtggcaggtgctcctggaaacttggggaggaagcttgcagccctgccattttttcctcccgaggattcaaagcccggcacctccagggtgggtggggagaggaaagcttaattgatctcttttattaataaagcgactgaataagccacgcctcc

SEQ ID NO: 13650 - DNA, 8251 bp, Homo sapiens
  ENST00000382850
cgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttcta

SEQ ID NO: 13651 - DNA, 2920 bp, Homo sapiens
  ENST00000256830
atggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctt

SEQ ID NO: 13652 - DNA, 165 bp, Homo sapiens
  ENST00000590694
ctcttccgtgtctcccactccccccttttgaaacaatcctgctaaatcactgcctagtcctctctcgaccagccacgctcggctcttattgggagagtcccgtattctcagagtaaaagttgtttctggaattgatctcgccaaaaaggacatctttggagccag

SEQ ID NO: 13653 - DNA, 233 bp, Homo sapiens
  ENST00000591989
aggtaggagtggtttgccatctggcggggtgcgcgctcaggtctggctcccctttcgagaggtgaattttacaacccaagaagcattactcagcagggagagtcccgtattctcagagtaaaagttgtttctggaattgatctcgccaaaaaggacatctttggagccagtgatccgtatgtgaaactttcattgtacgtagcggatgagaatagagaacttgctttggtcca

SEQ ID NO: 13654 - DNA, 144 bp, Homo sapiens
  ENST00000591579
gtggtttgccatctggcggggtgcgcgctcaggtctggctcccctttcgagaggtgaattttacaacccaagaagcattactcagcagggagggagagtcccgtattctcagagtaaaagttgtttctggaattgatctcgcca

SEQ ID NO: 13655 - DNA, 484 bp, Homo sapiens
  ENST00000592846
atctggcggggtgcgcgctcaggtctggctcccctttcgagaggtgaattttacaacccaagaagcattactcagcagggagagtcccgtattctcagagtaaaagttgtttctggaattgatctcgccaaaaaggacatctttggagccagcttctgctccattgctgttgaacttttttttggtcgtgacatcagaaaaataaccaagttgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttct

SEQ ID NO: 13656 - DNA, 241 bp, Homo sapiens
  ENST00000585363
attatctgagacaggctcgcgttatggctccgctttctgcggctctcctaccctggcatggtgtgtgtgtgtgcctgtgtgctacggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaag

SEQ ID NO: 13657 - DNA, 1304 bp, Homo sapiens
  ENST00000588516
agacattcctaaacaaaggggctgcttgggttgacgtattgtggggggtgggggtgaggacagctgcatttcatcctaggttcttttaaaaaatgttttaataacatgattatttgtaaaaactcccccgaaaaaacgattttaagagtgttttgggaagtgcagctggataaatgaaacacgttaatgtcactgttgtttgtgctttatttacattggcagtgagtgtcagaatctacctagagcacatcttgccacttttgtccacaggagtcactactaatcatcataactgatgtctagtgtgaaagtgaagcttggaatgtaaacagagtccgagtgtgtgttggcatgtgactggattcactcctgcatgttgctagaagggaatttggggctgtataggaaatagcaagaggtgatgaagacaccttttattatctatttattgccatgtcgctggtagtatttagttccacacacattgtatttcacaagatgagtctcagccgtcttcctttttcaactttctcctaccagtgaaaaaataagccagggcagttctgatgacttcacatttcattggtatttgtttttcatgggcagtttcatgctgtcacgttgcccttcagagaatcagggaatgccttcgtagaatattaacgacaaattgttgaatttgcacagcttgttttgtctccctgaattagtatgtgtaagaaaaaccaatggaagattttagcaggctctgaaagtagaatgcccgctgaagcaaacggcagggttgttcttccaaggcgtattaaatatgggtacacttagtttgcagacttggtgtgctgcagaatatcacatatgaagatattttgaccgctatttagaagagtgacctcataaatcttttagcaaagtagacacacatacctaccacatttcttaaaagtagattcgtattttgatttgagattgttgaaaagcatggtatgtttggagtgcacttagttatgtcccatctcataaagactgttgagctctctgcactgctgatgatgaagcattgcatgaacccagaaaacggggatgccaaagcacagggcttaggtgctgttccttgcgtcatcagcagaggtctgtccactttgtagaagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaag

SEQ ID NO: 13658 - DNA, 220 bp, Homo sapiens
  ENST00000585594
attgtcagtaacttggtttttaagcttcagactgtatttcctcctcacttgttaacaccagaagataaatgaatgtggctcttggattgaactacatctacagggagctgaacttcccatgttgacgttgaattctagagtatgcttatgctgattcttgagaaattgggagagtcccgtattctcagagtaaaagttgtttctggaattgatctcgcca

SEQ ID NO: 13659 - DNA, 889 bp, Homo sapiens
  ENST00000587547
attttatttcatttgagatttcagactttgtcgcttgttctttctgtagaagttttttcatagaagtatgttgtttcaaaagcaaccttcaaatagtagacttagcttggatgagaatctaaaagtctttgagtccaacaaccaagcaggtcccctgtccaggaagtaccttatagctgatgtttgagtatccctgcagatgggaactcactacctcctgaagcaccttacttctacccttggaatagtaacagagattaaaatgtccttccttaatttgaggtgaaatctgccttcttgtccattttacacacactaaccttccttccaccatgcaagctgagagagagccaggttgagcctgtgtttccacaacaactcttctcagacctcctgctgccacctaccatgcacttgctcttcactggctaggttccagttgctctgtacctttcctaaagtgtggtgaccagaatttggcacagtgagggaaggttccagagccctttagtgttatcgggggcacagagcttgggctttggagtcgctcagatcttgagttgatatgcacttctttgtccttgagcaaatgattgaaccttcttggactctcagttcctcattaataaaatgaagatgaaacaagatgagatggactgtgcacatttcctgatgggggctggtatgtgctggtgcccagtgcaaagtggctgctggcagaatggtgagtcaccagtacctgctcccttcactgagtgcttcctgtgtgcctggcaccattgctcagggctttacatggacttactcatttcattttcactgcagcctagagcgtaaggagagtcccgtattctcagagtaaaagttgtttctggaattgatctcgcca

SEQ ID NO: 13660 - DNA, 3417 bp, Homo sapiens
  ENST00000435432
gccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaggtaacactcgggagagtcccgtattctcagagtaaaagttgtttctggaattgatctcgccaaaaaggacatctttggagccagcttctgctccattgctgttgaacttttttttggtcgtgacatcagaaaaataaccaagtgtgagtctgataatagcaatgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagccc

SEQ ID NO: 13661 - DNA, 3543 bp, Homo sapiens
  ENST00000357895
gccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaa

SEQ ID NO: 13662 - DNA, 3347 bp, Homo sapiens
  ENST00000586263
tttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctt

SEQ ID NO: 13663 - DNA, 4978 bp, Homo sapiens
  ENST00000456173
acttccgtgttccccacatttgaatttgctcccgattcgagagaggcaggcatccgcggcagcagcttccaacccagacaggcttaagccgcgcgagggtgcccgggtgggtggctgcgcagggccctacctgggcgggagcggctgcagagccctgtccacgcggtgcctccccagcacggcacctcccactccaggctgttggttacctggccgggagctggcggagaccaggatttctcctcgccgccgttgctgttgttaggggaaacagaccatctgcatctagacctgcctctctctccgctccccacttcagacgagctcttcctgcctggaatctgtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaact

SEQ ID NO: 13664 - DNA, 505 bp, Homo sapiens
  ENST00000588494
aggggaaacagaccatctgcatctagacctgcctctctctccgctccccacttcagacgagctcttcctgcctggaatctgcttctgctccattgctgttgaacttttttttggtcgtgacatcagaaaaataaccaagtgtgagtctgataatagcaatgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaat

SEQ ID NO: 13665 - DNA, 579 bp, Homo sapiens
  ENST00000588066
accgatgaggtggaaccaaagctgttcagcagaagagagcaaccacagagcagcctgttgggtggagggcttgagggttcctaaaatccgaggactttctgtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaa

SEQ ID NO: 13666 - DNA, 3338 bp, Homo sapiens
  ENST00000431212
atcagtataagtagcgagctgggcgcattccttctcagttgtgttaaaacttgctggtattcccccggtatcagcagaggtgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaa

SEQ ID NO: 13667 - DNA, 830 bp, Homo sapiens
  ENST00000586268
ctcagttgtgttaaaacttgctggtattcccccggtatcagcagaggtgtgtacgggcactgctttaaaactgggaaggaggaagacgaggccagggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgag

SEQ ID NO: 13668 - DNA, 553 bp, Homo sapiens
  ENST00000587190
agttgtgttaaaacttgctggtattcccccggtatcagcagaggtgtgtacgggcactgctttaaaactgggaaggaggaagacgaggccagggagccggagggtcaccaaggtagatttccagcagcgctagtccagctgaacactttccagccttgtttttcagcagctttgaggaaaagtatagcttctgctccattgctgttgaacttttttttggtcgtgacatcagaaaaataaccaagtgtgagtctgataatagcaatgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaag

SEQ ID NO: 13669 - DNA, 381 bp, Homo sapiens
  ENST00000585323
tttaaaactgggaaggaggaagacgaggccagggagccggagggtcaccaaggtagatttccagcagcgctagtccagctgaacactttccagccttgtttttcagcagctttgaggaaaagtatagcttctgctccattgctgttgaacttttttttggtcgtgacatcagaaaaataaccaagttgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctggg

SEQ ID NO: 13670 - DNA, 628 bp, Homo sapiens
  ENST00000587634
acttggcattgggactggcattaaaaatctgttttgcaaacaggagccagtcttttgattagcagggaggatgcctgcgagggacggaggccattgttccctgtgttaggcgttgttgctggttcagtttctaggcgagtgggggctgtctagaaggctcaccaggaaggcagctgggaaacttggttgcctgctggatgtggagccaggaccaaagccggcgactggggctattgcaatggatttccttccaaagggaggtcctccttctccctccctttccacggtcgagggagtagctctgtagctgggtttgccctccttctcctgctgcccgcctcctgacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaa

SEQ ID NO: 13671 - DNA, 4402 bp, Homo sapiens
  ENST00000635997
ttttgctcttatccaatcatgcctggaatgccgcttgccacttgggttatttctgctatctgtcgctcccggtgccgcagtgctaacagtttggcagatgggacactttttcttggaatttgtgtctttggtttgtgacttctggcagtgtcgggcctgttgttgccgcttgccctagccctcctggcccccctggtcaccatggcccatcggcttcggtttcattttggctctggtcgcagcaacacagcccccgaatcagacatcctagaccaggagagagaagacgacttcttcatggcattccacaccctaccgcggagaagcagcccgcaccccttcgcccagaacggaggggaggacggcggcggaggcctgcagggaggcgtgggtgcgcttaagcggagctcgtccatgttcatcccgcagctcttgaccagcatcgacgcccgccccacgtgcagctcctccgtgcagatctccctgcagcgcaaggccacggacggggccacggacgggtgcgggccgcccgagggcgccgacgatgggcctccatgcgcaacgcccgaccccagggaccaggcctccgccactgccaccacgagggcctcgccccagagtggctcccgggagccctcgccgagggacacccccgggagctcccctccgagggcagcccgggacccagggctccaggtcaacggcacgtgcggccgccgcgtgcggtgctccggccccgtggactgcgcggaggaggctgccccgggcctgcgcatccagcaccgcgcctccagcgccgacgtgcgccaggtgaggctgctgcccctgggccccgatggccagggcggcccggccgcggcagagcccaggcgctggtccctgcagcacgttccagatgcttctggaagctctgggaagcggtgttttgtcttccagttgcagcagccccaacaaggcgcttcggggccaggcagcgacctcaactttggcttcacgggcacaaagggggacaggttggtgaggtatcctcgcattcggctggagaggagcacctcgtaccccacgcagccccgaagcgagcgagggagccccacggaagatcggggagccctggaggcatcgcctcgagctggcaggatggctcctgaaatccgcaggacgaactccgcggagaggactccgcagggccaggggtgcacatttaagatcaggcaggatcagaacgcggggcagcagcattttagaattcttgtaacccgggggccggaagaagctccccagaatcccgaggagaaaagcgccaaaagccctgtttccacgggagctgacaccacgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaa

SEQ ID NO: 13672 - DNA, 551 bp, Homo sapiens
  ENST00000592601
ttattctcaaggccttctgctgactgctgctcttgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgag

SEQ ID NO: 13673 - DNA, 710 bp, Homo sapiens
  ENST00000590020
gaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccggtaacccatgctaatttccagtcatcagttgactttttgggctttcatttacaatcatctgggctgctgcaaaaagagtttttcctgtgtaaatttatttacaatataaatgagatgtttttaaattt

SEQ ID NO: 13674 - DNA, 1984 bp, Homo sapiens
  ENST00000587881
agggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcct

SEQ ID NO: 13675 - DNA, 754 bp, Homo sapiens
  ENST00000589167
ggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacggtaatgatccactttatcagacatcaatagcaagaggccgtgaggcagttttaatatttcgtgtagtggtgaatatacgctgtttttaaaaataagattagctcctttgtgctacagagctgcacacgtttcttattttaagcttctcatttggggattgtttaaaggtactgggtaaaatagaatgatttttttagtcccacataattttattaggaatactatcaggctttggttaagtgcatttaacttgaccatttagaagatatttttgacttttagtgtttgtactcctgataagtttttccatttcattagaatgcttggttaaagtaatttggttggaagatcatcaaagaagccacaggaattgcatgagactgtgtgtgtgattcctggatgtgcccagggcccttctcttttctgtatctcccctaccacatttttcacagggggttagacttttcttgtccccagaatgcaccatgaccctttctctgccaccaggggctctcctcacacaatgaacaagtttccgtaattccaagggaacat

SEQ ID NO: 13676 - DNA, 862 bp, Homo sapiens
  ENST00000590638
ctgggtgtaccttactttattaaactgatcagaaaacaaatgcaaggtattaaataataatgatttcttgcacaaacagccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatg

SEQ ID NO: 13677 - DNA, 487 bp, Homo sapiens
  ENST00000585970
cacttctgcccagcagcactgccagtgacagtctgagagtggtaatatctcttagtctttgactcaaaaggtctcatttgacctctctgaagttcagctgatgatagaaatcttggttaaattattttccctcagtgctttggagattctcctgcatgtcttctggcctccataaatgatgataacaggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacgta

SEQ ID NO: 13678 - DNA, 406 bp, Homo sapiens
  ENST00000587246
gaggtctcctgtgtaaaggcaaattatacccccaccccggaggaatcagtctgtgatcccagtttgaaaactactgatccacatgattgtgaaccaagcaagatcatttggacaaatctaaaaatttgcagggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaag

SEQ ID NO: 13679 - DNA, 582 bp, Homo sapiens
  ENST00000592097
agtcaaatgagtttgtattttggggaaaaaatgctgaattttcactcctgtgtcattctgtaggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgttt

SEQ ID NO: 13680 - DNA, 730 bp, Homo sapiens
  ENST00000590248
gtaggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggtaactccggggcccagccccagccggtgtcctccacctgaggcaggattgagggctgtgtggcgccctccattgtggtctgacttcaggactgatgctggctttggggtctgttagagcttggactgctgggggagggaagaggcaaactgagccagcagccccgtggtggctcctctgtaactgtagcagacagctagacttgaatgaagttggtccctacaaaagcacactggccttccttgaccacctcgtgaaagtgacttttatttgagggactggtcctccaatgcgtaaatagaaatggggggcttctcagggcagaaa

SEQ ID NO: 13681 - DNA, 2066 bp, Homo sapiens
  ENST00000588712
cagcaaaaataatcagctgtagttgccttgtccatcagagggcagttctggaacatgcctagtaagtagaggccactgagcagagctgggatcatggccctatgcaccaggcgaggcaaattgccacaacaagtagaaacaaggtttgcagtagccctctggacagcagaaacctgcttacactaccagactggccaagtatcctctgctgcatccccatccacccccaccgtggcagccaaatgggggtcttggccacaaggtggccgtaagcatctacttgggcctgtagaacgacgtctcattgaacttgaagtggtttatgttgagtgaggaaaaatgtcagaaggcaacagggttgtagcaaaaggtagtttagtgattgtctagttcagcttcttggtgttgacatagttgagtaacagccattttaaaaacaaaggaatatctcgccctttgttgtgtcgagagaaacaggggaaagactgtctgttgagaagccgttggtgggactcggccatttgccccgtccatagccagtgagtgtttcccatacactggccttctatacttttatctcaaaacagaaagttcaagatcgatgatgtctatagaaatcatatacctcaagcctttcctctgataggtgggaaactgaggcagagagcagctgggtttacccagcaaggttttggcacggtcaggcctaggaactttatttccaggcttctggcttagttctgtttccatttcattctggtacctttgcataaatatcttccatttgtccacaggaaacctcccctgatggagagttgcataataggaacggcaaaccttagactaaatgctaagtcgaagacccagttgtgccttagcgtatgtctgccattcttaggcctctgggcagatgaggtgatttgtcatcactggaattgatcaacctggaggagagtcataagcactaattcttttgtgggtagggagatgcttttagatattcagaggaataacctctcaggaggagaagcagccagggtaatgcacagatgctgctggagcgtgagagaatccacaggtcccatgcgtaagactagaggggtagggaggacgactgtggcatttttatatccgatacgacatgccgtggcttgcgcaaggttcgaattgagctgccctcgtgactgctgcctctgtgatctgctatggcaggtggagcctggaacaggtgtctgccttcctctgttgttatgatttgctagcttaccttcgcggcacagtgaccacatgctggcactgagggtggtcatttctcagtgtgtgatctcgcacctttcacatcctgcttttacatctggtaaattttcttcctagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatg

SEQ ID NO: 13682 - DNA, 2743 bp, Homo sapiens
  ENST00000590506
cacttggcttgttttagatgtttgcctacagcagtccaagtggcattaccagtaaagccacctggattcccataataatgcagatatgtaagatacacagattattttagaaccccatctttgcctttgttgttttgtttttgttttgttttgttttgtttcattttataaaatgatgtcttctagggaacgtgtctacaatctgaaatcccatctcataacctggcttccccttgtgatgacaaatcttaaatactgtatatttataattggcttagggggaactggtaagcctcgaacacagaaacatgagcttggtgccatcagagagtttgctttttatatcatttattttggcctattggcagaagaagaaagagacggacattgtgatcactcagtctcttagattagagaggccagctagtattgtggccataaaaaacctactcagttttcagagtcaactgtctaggtcttacattgcaatataaataagattaagttctgcctgcctgcatgacagcagcatgtgccatgggtcacgtggggggtataatgaccttctgcctctgttcataggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaact

SEQ ID NO: 13683 - DNA, 8436 bp, Homo sapiens
  ENST00000456986
attttgaccgctatttagaagagtgacctcataaatcttttagcaaagtagacacacatacctaccacatttcttaaaagtagattcgtattttgatttgagattgttgaaaagcatggtatgtttggagtgcacttagttatgtcccatctcataaagactgttgagctctctgcactgctgatgatgaagcattgcatgaacccagaaaacggggatgccaaagcacagggcttaggtgctgttccttgcgtcatcagcagaggtctgtccactttgtagaagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgcccagtgccccagctgggagagcgcgttcatcaactgtcacgggtggtgaggaaccaacgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaaaaaaaaaaaaaaaaaaaaaaaaaaattcccgctcatgagttttgactattggtgagatgttttccgctacagttaacatgacaaatgtctcagtggcaaaaatcccctttttgtaagcccccatagtctagaggcagttttctttttaagaatcatgccagagcctgagtcgagcagtatgctttcttggtttttgagagtaattgtgtaattgtagagggagaaatccaattctaacctaagaactgggattcttctgtcatcttgtaaaccgtatattgaaaaaaacagaatgtcactaaatgcatattaagtcaagtattggaaagtataaaagaaaaatcattctgacaatttctaagccagaagcaaacaagaattactgaaatctaccccatgaatacttggaaggcagtaattgtgagtgacacctcagttcatcaaccccttaataatatcagcttaattttaatgacaactaaatatgctgaagtgaggatttagtattttttaaaaaagcaaaacaaggttcagtagtcctcagcaattctccaagtttctctctttgcctaaaatggtcatagatcttgatttctctgaatcgtgatgaccacacccagtcatcttcacagcataattgcaggtggcagtaaagagagtgtgctgggtaaggagcagttgctgggtcattccttgggccccgacctgcccggggagtagccctgggggagagagggcagtgttgcctatcccagaggtcccagcagtcacactgctctgcaggccgggctctctttatagccagagaaatcaccttaatgcagtctctttagttgtctgctgaagctgtagttattatgggccacttacatgaggctgagaagtacgtgccggagctcacacactgcctgttgcggttctcttaacatcagttatcacagctgcctgtgggtcccgggtatttccattcctgccccttgttggcccgaggaaggatgtggaaagagcacctggtgggatgaaggtccaacagcctgtgcctctccactgctggccctggagccggcagcagtgaggcattcattgtctgtgttgcggtgtattcccagcttcagtgctcttttcctttttgcctgaaatgtttatgcttctctgcagccagtcctctaacaaatctcaagaacaaaggtaagacacttggtttttgtttccaggacccttcagaaggtgacatcagatattccctaaattcagacaatgagggatacagagcgacttggcatgtattatttctcccatgtaaggacaaagggacagattattattgttatttctgagacagagtcttgctctgtagctcaggctggagtgcagtggctcaatctcagctcaccacaacctctgcctcctggcttcaagcgattcttctgcctcagcctccccgaatagttgggattacaggcacccaccaccacgcctggctaatttttgtatttttagtagagatggtttcaccatgctggccaggctggtcttgaactcctgacctcaggtgatcctcccgcctcagccttccaaagtgctgggattacaagcatgagccaccgcacccggcctcacagtgacagattctgagaaacagcatgcaaaacatttgaaccattttctacatctcccattgttgcatagagagtgtgcaccgctgctatcttgccagatccacactggtcctcccgaaagccaggttcatacacagcaactttttaattattctaacagttacccattaacagtcgactcctgtatttctgagagtcttgtactcacctctgaaatttaaaaacgtataaagagagcctgggttaatcagttctgcagcccctacgtgacactgtgctagttctccttcttctgtctcctccttaccctggccctgcacccctgtacttaagagggagaggtgggaggtgctgtctggtatcatttgctgcctcgccagtagagggtgccgctgtgcagggtaactgcccgcctgctcccttcctgacctcccctgaccccgaagatcactacctctgtcattcaggcattggggtacatcctgataagtcgtgtcagaactgccaatttcaggactgagatgtgtttttaaaaaacaaatccttataaactccactttgtactttagattttaaaactggggaaaaatgtgatattctttggaccacttttttaatttatataagccttaatgaacagtgtctatacatttgcatacacacacccccaccccagagtgttctcagtatgtcagagaaagtgccacagcattaggacgggagcttggagaacgttttctagaaaagggttagcttcctgttggcatgaaattttccaagcaaacctcattaaacatctgttgtttgttaaagatgttccactgaaagcaacgcatgtttcaaaggcacgtctttccgttcgttggttttctgtgtgtaaggagtagcattgctgttggcgcctaacctcgcgtgcactgcattctcaaccccgtaccagtgcatcatcagaagccttcctcgtgaccataactctgtgtctgcagatatgtgttcccgtgtaagccagttttccccttttactcagactgatttcacctagattgtcacggtttccttcatgttaactttgcgtgactttgttcttcctttactactctgtatgtaatatatatacatatatacgtacatatgctgtccaaatatatttgtatatatttgtatagcatttttacacctttattgagtaatctggtttcgaaaggaggtgagagtttagtcccttctgcagttttctccaagctgtgtcctgtgaatttcaacccttggagcctaagaaaaccctaggaagatgatgttaatttgctgtcatttcctaattcaggatctatcatcaaatgaaacatgaaaaaaacagtgacttttaaggtgaaaagagtttcaagcattccaaataaattatcaatgtttcataactttttattataaacccacctcctaataggaagccaagtactatttgatacagtggtaaaaaccaaactaccttgaatttttttaaggcaacttatgaataatgctcattttcacagtcagaatagctttaaaatatggttgaatttgatacacacaggaagttttcttgaagaacaatcctttcgcttttcttttttcttgagagatctaaagagaaactgtagattgttttcctgacagcaaaagactaatgtgacaaaatgaagtcattgtaaagaagcgatgcaacttgtcaaatatttaataaagaattatggaagctggaacattttctac

SEQ ID NO: 13684 - DNA, 3783 bp, Homo sapiens
  ENST00000310624
gccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagctaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtagccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccaggccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccggggactggccactgaattatgccagggcgcactttccactggagttcactttcaattgcttctgtgcaataaaaccaagtgcttataaaatgaaaatgttgctgctgttattctctttccctgggaaggctgggggcagggcaggggaggtctggatgtgacaccccagactgcatgggactgagcaagcatcagt

SEQ ID NO: 13685 - DNA, 4082 bp, Homo sapiens
  ENST00000610854
tacacataacctagcctatttatttgtatctaaaattccctagccgcaccatcaccgtaaacaccaagggaaaaaattaaggaggttcctggtgggaaaagggcgagttggggggacagggtgtctgcgaggtgacgggatacagaaaactagggtgtcaaaagggagcaagaacctgttttgggggcaacttaaggatccaagtgtcacggggtctgggcaatgcaggacgggaggggctgcgtgagtgagtacagaagggaaatgagtgagggggcatgggatctcagagaaaatcagggccctctgagcaaagtggaaaggacgaccgccgcagctcctcgggccgtagctcgaccccgccttcccttttgcgcagaatcctcgccttggctgcagcagcgcgctgcccccactggccggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggaccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggagatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaa

SEQ ID NO: 13686 - DNA, 1497 bp, Homo sapiens
  ENST00000615973
ttggctgcagcagcgcgctgcccccactggccggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggtgcggcacggccagaaacacaggggggcgggggactcgagcaagggggggagttggtgcgcccagaaagtggagaccaggggtggtgcggctgcacgcagctcttagggatagggcttggctccttggccactgtgtgggaggggtggggcacttgaagggcgtgagtgcgggcgccactgtagtctgggagtgtgctccgtgctgctgcaccggcgttccgcattaaagctgcccagcccttgtt

SEQ ID NO: 13687 - DNA, 3205 bp, Homo sapiens
  ENST00000639464
atgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggaccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggagatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacct

SEQ ID NO: 13688 - DNA, 1879 bp, Homo sapiens
  ENST00000619417
gcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaagccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggaccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatg

SEQ ID NO: 13689 - DNA, 4020 bp, Homo sapiens
  ENST00000221166
tttttttttgttttgttttgtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacggggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacata

SEQ ID NO: 13690 - DNA, 582 bp, Homo sapiens
  ENST00000523467
aacgctgtgacagccacacgccccaaggcctccaagatgagctacacgaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacg

SEQ ID NO: 13691 - DNA, 2500 bp, Homo sapiens
  ENST00000518131
gctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcattt

SEQ ID NO: 13692 - DNA, 1885 bp, Homo sapiens
  ENST00000521540
gtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaatgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagt

SEQ ID NO: 13693 - DNA, 2519 bp, Homo sapiens
  ENST00000433454
gtgcccaggcgccctctccgccgcgctccctggtggccgctcgctagagcacgcgcgccgcagacctagggtatttgcggatcagcgtcctcgcccatctcatcctccacactccgcccccacccacctgccccagctgctaagggtcttgacctttttcagaaacgtgcatcttttccagttctaattttgcacgcttgcacgtttaaagcaggagggatgaattcggtagtggataaatcagcaactttaggatagcttatgcagaaacgcgtgtattctctacttttccggcagtgatcggaagagctctcaaaattggcttcagcccaaagggctcagatgggaatggccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaa

SEQ ID NO: 13694 - DNA, 3148 bp, Homo sapiens
  ENST00000437366
gtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaac

SEQ ID NO: 13695 - DNA, 12811 bp, Homo sapiens
  ENST00000357731
gaagaggaggaggggaggcaaaaacaccgaaaaacaaaaagagagaaacaacacccaacaactggggtggggggaagaaagaaagaaaagaaacccacccacccaccaaaaaaaaaaaaaaaaaaaaaaaaaaaaaaaaatcctgtggcgcgccgcctggttcccgggaagactcgccagcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacctgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactacgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactctattagcttaagagaaagaaggaagaaataataatttgaagatatttctgctattctctttatttcctgtattacactcatctttctgcttactctaaagcagtacagggtaaaaattctagatgctacagtttcaaatgactccacactatattctttcttgctgttgctgattcctaaaaggtttgatgagctgaactacatctaaactaaaaataaattttctggaaacattttattattaattatttagaacctttacctggtaaaatacagcagagttagcaacagagactaaatatcctgttgataaaatcctgatgatcttacaggctaaacaactgaaaactcaaacgcttgtaagagccaggcagagtgtaatttcttaacagctgggtataaaacaacgggcacctgaaggtattcagatacaatttccttaaaaataccttggtttccaagcaaaacacgttatttggctgagaacctttagtttgtaaataccaaaccataatatacaaatgagatctcaagccaaatgaattttttaagccctctttcccatatctgttcatctatgatagtcaactgaataaatgagaacaatgtgatagataaaacaacaaagcataaaaaagattcatgcttggttttataagctattttgaaatataagtatcattgctattctgagaaatctatatacaccaaagccctccctccacaaaaaaactggaaatgttctaataaatgtctgatttcccccacagcttcattatttcttcccttttcaacatctatcttatctatcttgcataaattacatcacagaaacagaaacatcaagtatcagacatggaaaaccagcacatgaaacagagctagtttccctctcaaaagaatagggcaaaacatagatgcttcaaaatcatatcttggtatacagaaaataattattcactttaacctgacagtcagaaatgtaagtaagaatttgtagagataattttccaaggtaattcattcaagttagtggaatttgatccaaacacccgtcaatgtactccctctgaactttccaagaatcatacaccttcacatttacattcactgtttttctagtaattccaaacttactcaaaagtatttcagaattgatatcactggtggaaagagagcaatttagcaaacaaatacatgctttccggtattcctagagaaaaggaaaagaggaatacgtttcattcttctccctagaagctctacccacagtcatcctaaagctagaccaatctctcccagggctttccttcagtctaagaaacatgcttcatttcagagacaattgtggcaactatagttttccccaaagggtcacaactacctctcctttgcattttacaatggagcacttttgcaagtgttgctattgtggctttctcaacactttcaaatacttaaaggagaaaatattactattgtcatgtattgatggtgaaaacgagattcagaaattttgagtcacttgctgaagattatacttcaactaagtggcagatctgagccaaatatgcaatgaaaaatgttcccaatttgtttccagtcccagactacctaggaaaaagaaaagcatataatcacattgctagcttcatagacaactatttgcatatttttatttatatatttatataaatataagcacattttaaatataaatatagatatttatgacatccttgtattttccaatacctgcagagggtatgagatttaaaggctaatcagattgtacatgtcatctaaaactttggaaacgtgaaactcacagtacagttgcctttggacacacagccttgggttgtatgagactggtcacaccaagtggagaatcttgtcataatcgcatgtatcttctttttgtatagcattttgcaaaaaatgtgtcaagtttgggataatccactaagactattcctcagacatctgcaatcaacagaattttgggggaaatggagatcagaatacatacacacttttaaaaaaattcacaatactgattttaatctgagtgatgttgtttgaggccatttatattgaaatactaacatgaacatctgtttgtgctgggacagtagaacaagagaaagattctaattctagaaattaaatgatatgcaacctaagaaatacatttgtactttgttttcaaaatatgaatataatacaaatcctatggatatcaccacttagtttgaaaaacataaaaagtgtgattttcatacacttatgaaatgaataaattaattcattaatgaaggacctgataagacattacaaccagataaaaggataatttaaagaacatacacatttatagatcaaaaaccttgaaattaatgtactaatagaggcaaaactggcttccagagtgaggaggagaattcaattgaatctttacccctcagaatttatttccatatctgtagacgagaaatattttgccttagtattatttatttacaacttgaaaaagagttcaaatataatgaaaaatacagaggctccaaaagaatcagaatcaggtaacctgtaaaagtgtgttccaagtaattagtggtttttcatttcagcaaaaattcttctctgcaatgaagagacataatttttttttctttttcagagttttgctcggttgccctggatggagtgcagtggtgtgatcttggctcactgcaacctccgcctcctgggttcaagcgattctcctgcatcagcctccccagtagctgggattataggcacgtgccaccacacctggctaagttttgtatttttagtagaggtggggtttcaccatgttggccagtctggtctagaactcctgacctcaagtgatccacttccctcggcctcctaaagtgctgggattacaggcgtgagccaccgctcccagacgagatgtaaaatttttaaagccattgaattaaattcattgctaacattttgagctttgataatgtaatgcctactttaatgacccaaaaaaaaaaaaacccaagtaacctatctatctaataatctatgttttttaattactccttttcttccttatctcacaaaccataatccaatagtctaggacatgtgaaagagaaagtaaacagtcacaagaactaccttgcttcgagaatccaccttgttgaaaaaataatatattttgggcacttgttaaaaagaattaacagaaaaagtctttttttttttgtcacaggggcatttaattcatggtataacaggaattttatatcaaaaacagtaagaaaaatgaagtaacagttgagatagcaataattcatcaaccaaatactatgataatgataaaaacattgcaagaagctatagccagaactgagtgttctgctcctacttagtgctaatgagcccagtcctagcacacatcttggtttggtagaaactacaggaggtagcatggttcattacaccttcaaaactttaaaatgttaaagagggtggtttccctccttcatttcaaatggattgctaaaagcactgggctattccttggtggaaatttgaatttgccagtttcttcatcaattttgactttttacattcaaaaaggagttaactttacactaagtcacagcagacttagacctcccgcagttctgaattgtgcttaaacaagtattcaagcacatggggatttctcaagaaaatttggggaccatatcttagaaaaaaaacttacaaaatattcgttgaagactataatatgctaaagctaaggaacaaaattctcttgattgttctaaaaatacctagtaagagccacagaactcttccatagttttctaagtagtttcataagtgtggattgtggttgccctgaaacttgacatctccctaccaagtacttgacaagtgacctggcaaaaatgtgttcaatagctcatttttgacatactccttaagaaatcattgccagagatttgaaactgcttcaagctgatgtctttttcaaaacaaaacacatactcacacacaaatacaaaatcgcattgctatcagtgatctggaaaataagcttgcaagctggccatgtggtgttctgaataatttttttaaagtagaagaagaaatgacaacagtgcaaccaacagtttctgtttaagttttatttgctaagacgttagcataaggaacatcttgtgatttaattaatcagaagatggcacctgctgtaaatactgacatggagaaaagcagatttttaaaaaaatttggaataaattaatttcttgtaatacatttttcttgttgataaacaactaaattatgctttgaaatgtgttactgtctaataactttaaatgttgacaaggagaaagactgggtttttttttttacatttgaataagcaatttttttctggaaacatatatatttctaatttatagataaactagtatgtgtgttcagaattcctgctctctcattattcaggtttcaaaatgtattaacaaagcttttatggttttataatagacaattagatatctttcatcaggtaatgtaagaacttgtatagtggtatattagtcagttttcacactgctgataaagatatacccgagacagggcaatatgcaaaagaaagaggtttttttggacctacagttccatgtggctggggaagcctcacaatcacagtggaaggtgaaaggcacgtctcatatggcagcagacaagagaaaagagcttgtgcagataaactcccccttataaaaccatcagatctcatgagacccattcactatcacaagaacagcatgggaaagacctgctcccatgattcaattacctcccaccaagtccctcccacaatccgtgggaattccaaatgagacttgggtggggacacagccaaaccatatcattccacccctggtccctcccaaatctcatgtcctcacatttcaaaaccaatcatgctttcccaacagtccctcaaagtcttaactcatttcagcactatctcaaaagtccacagtctaaagtctcatctgagacaaggcaagtctcttctgcctatgagcagccagtaaaatcaaaagcaagttagttacttcctagatgcaatggaagtacaggcattgggtaagcatagccattccaagtggaagaaattggccagaacaaagggactacaggggcggtcaagtcttaaagctccaaaatgatctcctttgactccatttctcacatccaggtcatgctgatgcaagaggtgggctcccatggccttaggcagctccgcctctgcagctttgcagggtatagccctcctcctggctgctttcaccagctggcattgagtgtctgtgccttttccaggtgcatggtgcaagctgttagtggatttatgattctgggatctggaggacagtggcccacttctcacagctccactacgtggtgtcccagtagggactctgtgtggggctcactccacattttccttctgcactgccctagcagaggttctccatgaggagaacttcattctgggcatccaggcatttctatacatcctctgaaatttaggtggtggtttccaagcctcaatttttgacttccatgcacccacaggctcaacaccatgtggaagctgccaaggcttggggcttccactgtctgaagcaacagcccaagctgtaccttggcttcatttaaatcatcctgggagcaactgggaggcagagcaccaagttcctagactgcacatagcagagggaccctgggccaggcccacaaaaccatttttttcctccaaaacctaggggcctgtgatggcaggggctgctgcaaaggtctctgacgtgccctggagacatattccccactgtcttggtgacattcagctcctcattacttatgcaattttctgcagccagcttgaatttctcctcaggaaatgggattttcttttctatcacattttcagtctgtaaatttttcaaacttttatactgtttcccttttaaaactgaatgccagccaggtgcactggctcatgcttgtaatctcagcactttgggagtctgagacaggcagatcacctgaggtcacgaatttgagaccaacctggccaacatgataaaaccccaactctactaaaaatataaaaattagtgaggcatggtggcacatgcctgtaatctcaactgcttgggaggctgaagcagaagaattgcttgaacccaggaggcagaggttgcagtgagctgagatcatgccactgcactcctgcctgggtgacaaagtgagactctgtctcaaaaacaaaacaaaacagaacagaacactgaatgcctttaacaacacccaagtcacctgttgaatgctttgctgcttagaaatttcttcctccaaatatcctaaatcacctctctcaacttcaaagttctacacatctctagggcaagggcaaaatgctacccatctctttgctaaaacataacaagagtcacctttgctccagttcccaacaagttattcatttccatctgagaccacctcagcctggattttattgtccatatcattatcagcattttggtcaaaaccattcaacaagtctctaggaagttccaaactttcccacattttcctgtcttcttctgagccctccaaactattccaacccctgcctgttacccagttccaaagtcacttccacattttcaggtatcttttcagcagcactccactcctgatactaatttactatattagtcagttttcacactgctgataaagacatacctgaggctgggcaatttacaaaagaaagaggtttatcagacttacagttccacgtggctggggaggcctcacaatcatggtggaaggtgaaaggcacatctcacatggcagcagagaagagaagagaacttgtgaaggaaaactcccgcttataaaaccatcagatctcatgagacttactcactgtcatgagaacagcatgggaaagacctgcccccatggttcaattacctcccaccaagtccctctcacaatatgtgggaattcaaaatgagatttgtgtggggacatggccaaacaatatcaaatggttttgatttttatgttgaggcacattctcaagctagtatcatttcaagaagaacctgttatttgttgattttggaaattttaaaaatcagatttaatttacactgaaaagtggttgaccttaacgtttctcagataacctgaaatgttcatgtggcattcattcattcattaatccatccacttatttgacaataaaatatgatttaggtgacctctgaagagctgtctaaaaagaattacctggtagagttaatctggatgtttaggacactatgatcaaactgaagaaaaaggcacccatttctctaatcctttctttgggaagctgatttcactttaaactgaaagtgagaaaggaaaaggaagaagaaaagaaacagagggtaaaagaagagaaagaggaagggaaagaaagagattaatgtatattttctcctaagaaaggctcttttgtgtgtgtcggtgtgtgtgtgcatgtgtgtttcctgttgcctggatctatcataaaaagcaatgtcttctctggaatggggcttcagtttccacatttacaattagtacatattacaattagtgatatgaataaaggctgttatcctacattt

SEQ ID NO: 13696 - DNA, 5577 bp, Homo sapiens
  ENST00000306821
gccatgtgaggacacagagagaaggcagccatctgcaagccaggaatagagccctcaccagagacctaatttgccagcatcttgatcatgtacttccagcctccagaactgtgagaaaatgcatttctgttgttaagccacccaatctgtggattttgttatggaagcccgagcaaactaatacaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacctgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactacgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactctattagcttaagagaaagaaggaagaaataataatttgaagatatttctgctattctctttatttcctgtattacactcatctttctgcttactctaaagcagtacagggtaaaaattctagatgctacagtttcaaatgactccacactatattctttcttgctgttgctgattcctaaaaggtttgatgagctgaactacatctaaactaaaaataaattttctggaaacattttattattaattatttagaacctttacctggtaaaatacagcagagttagcaacagagactaaatatcctgttgataaaatcctgatgatcttacaggctaaacaactgaaaactcaaacgcttgtaagagccaggcagagtgtaatttcttaacagctgggtataaaacaacgggcacctgaaggtattcagatacaatttccttaaaaataccttggtttccaagcaaaacacgttatttggctgagaacctttagtttgtaaataccaaaccataatatacaaatgagatctcaagccaaatgaattttttaagccctctttcccatatctgttcatctatgatagtcaactgaataaatgagaacaatgtgatagataaaacaacaaagcataaaaaagattcatgcttggttttataagctattttgaaatataagtatcattgctattctgagaaatctatatacaccaaagccctccctccacaaaaaaactggaaatgttctaataaatgtctgatttcccc

SEQ ID NO: 13697 - DNA, 192 bp, Homo sapiens
  ENST00000474357
atataggcatatacagaaaaagagagaagaaagaccagtagaatgattaaaataagaaaacaagaatccctcagccagagtcccatccagaatctttaataaagcatggtaagctccaagtacagcccagtatggaattaccgggagcgctgatgttcttttctcctgctggtaccttgtgttgacactgtc

SEQ ID NO: 13698 - DNA, 428 bp, Homo sapiens
  ENST00000478526
attggatattggacattatgttgttaagtgtttagattttgttttgttcccttaaagagtgttggattttttttaaacaggctcctgtatcacctgcaaattattttggtccattaaaccttgttattaagctttaaaggataggccaaaaagagtctttattctggcttttattcagccatacaactaaggcattagccttttggaatctccatcagtctctgcaaaaccatttgaaaatggacaatatttggacatttatggaattacaagggaccaggctggggaatatgaatgcagtgcggaaaatgatgtgtcattcccagatgtgaggaaagtaaaagttgttgtcaactgtaagtgtcatcaccttttatcaagataagttctgagaaaagataaaacaccttgaaaaattctgactgaaa

SEQ ID NO: 13699 - DNA, 726 bp, Homo sapiens
  ENST00000467479
acagagagaaggcagccatctgcaagccaggaatagagccctcaccagagacctaatttgccagcatcttgatcatgtacttccagcctccagaactgtgagaaaatgcatttctgttgttaagccacccaatctgtggattttgttatggaagcccgagcaaactaatacaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactgtaagtgtcatcaccttttatcaagataagttctgagaaaagataaaacaccttgaaaaatt

SEQ ID NO: 13700 - DNA, 2131 bp, Homo sapiens
  ENST00000366999
cggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtttccctgta

SEQ ID NO: 13701 - DNA, 801 bp, Homo sapiens
  ENST00000462283
gaacaaatgaatcgcatgtcctacaatgagaaatcagatatctggtcattgggctgcttgctgtatgagttatgtgcattaatgtaagtatgatgaagacagattcctagtctaagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctg

SEQ ID NO: 13702 - DNA, 661 bp, Homo sapiens
  ENST00000489633
gtggacccagaacctcatgagttaaaaccaccagtgaacttatttttccaagtttttaagacctagccataaaggagtcctttcttttgtcttggaaacacatttttgtccttttattttaactgctgtcttaggaggactattctgttatgcaatctgactataatactgagtattttttccccaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctg

SEQ ID NO: 13703 - DNA, 1865 bp, Homo sapiens
  ENST00000366998
ggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccaggtatgagaatcaacttggtcaacagaagctggtgctacaaatgaagaaatgtgcaccagtgttgctcccaaagtggcttaggtagcccttttcatttacaaatctcaaattttaagatggatttcattgaatatatgcatttcaatggaaacaaaattctgttatagcaatgatttatttcctgggttcatagacctgaggcaatgagtcatagaatttcatgtttgattttctttaccttatcaaactacatgtttagtaattgatacttatttttattatcattatttatttttttattttttttgagatggagtctcactctgtagcccaggctggagtgcagtggcacaatctcggctcactgcaagctctgcctcccgggttcacgccattcttctgcctcagcctcccaagtagctgggactacagacacccgccaccaagcccggctaatttttgtatttttagtagagacggggtttcaccgtgttagccaggatggtctcgatttcctgacctcgtgatccgcctgcctcggcctcccaatgtgctgggattacaggcatgagacaccgtgcccagccgatacttatttttaaaaattagggcatttacaaaactattgtatgtttcagatttcagagagataaactgcatttcaagtaaaaataaa

SEQ ID NO: 13704 - DNA, 1318 bp, Homo sapiens
  ENST00000540251
gcgacggttaaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagagtctcactttgttgcccaggctggaatgcagtggtgtgatcacagctcaatgtag

SEQ ID NO: 13705 - DNA, 6057 bp, Homo sapiens
  ENST00000233027
agcatgcgcagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccaccaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaatgttttcaggtgttttttttttgagacagagtttcactctgtcagtcaggctggagtgcagtggcatgatctcaactcactgcaacctccacttctggggctcaagtggtattcctgcctgagcctccctagtagctgagaccacaggcgtgtgccaccacacctggctagtttttgtattttttgtagagacagggttacaccacattgcccaggctgatctcagaactcctgggctcaagcaatccactcacctcagcctcccaaagtgccaggattacaggaatgagccactgtgcccagccctgttttcagtttctataactaaaaatatatctatctttgaaaattacacacacacacaaatactctaatgaaatgttccctttacagccacttaacaatttttttttttttttaagacacagtcttgctctgtcacccaggctgaagtgcagtggcccaatctcagatcactgcaagctccgcctcccaggttcactccattctcctacctcatcctctcgagtagctgggactacagttgcccgccaccatgcccggctaatttttttgtatttttttagtagagacagggtttcaccgtgttagccaggatggtctcaatctcctgacctcgtgatctgcccgcctcggcctcccaaagtgctgggattacaggcgtgagccaccgcgcccggcacacttaacagatttttatttagagtttactgtgtgccaggttctctgccaggagctggggatatagtggtgaataaaacaatacttcctgcccttttacagtgctcacagcctggtttctgataactcttattttcactttgaagggtttgctagaactcaacttgcaaaaccatcaagtcccaatgcccagttgggaacaaatctttggcaaacttggtatccttgagctattcacctttccgtgcatgttttggaaatccacatcgttctggagagtcatcagttttacttaatttttctaatgtattggtataaagtaggtattttattagaattaaaggaatctcacccatatcttttttttttttttttttttttgagacagggtcttgctctgtcacccagcctggagtgcagtgaggtgatcatagctcactgcagccttgacctcctgggcttaagtgatcctcccacctcagcccctcaagtagctaggaccacaggcatgcaccaccacacctggctaatttttaaaattttttgtggagaggaagtctgtgttgcccaggctggtctcaaactgcattcaagcagtcctcctgcatcggcctctgaaagtgctgggattataggcatgaaccaccacacctgacttcccccatactttcttattaattaccatactgtatatttttattttgtttaaacatcttttcttcccacttttatcgtttttacttgagtgcttaattcatcttcctaaattaatttaaaaactcatctttaagactgtgaattttcttccgaatatacctttggccacagttcagagactttgatgtgttactcttttggcattggttctaaaatgtcaatcattcttttttttttttttttgagatggagtcttcttgttgcccaggctggagtacagtggtgcgatcttggctcactgcagcctacgcctcctgggttcaagttcccctccctcagcctcccgagtagctgggattacaggcacacaccaccatgcctggctgattttcgttatttttagtagagatggagtttcaccatgttggccaggctggtcttgaactcctgacctcaggtgatctgcctgccttggcctccctaaatgctgggattacaggcttgaggcaccatgcctggcctaaagtgtcagtaattctgatttcggttttctcttttagaagttttgatttccacagacttacaaagctaaggaagttttatgtccttgctctggctacactgcagtgttactgaatatcacctgcacaacctttactgcttgcagttttttttttcctgttgctttgtacatgatccgttattcaaatggccttataggcattcaataaaggtgaaatgttaaatacaaaatcacttgtctattaaattttattcaaggttctatataagatctgataaatggaactttgtgatggaaatgttttatatggtagccactagtcacatatagctattgaacctttgaatcatggctagttttagagttttatattttaattttaattaaatagacgtgtctagtggcaccatattgtacaatgcagttctcattcaataaatcttaagtacttaa

SEQ ID NO: 13706 - DNA, 2576 bp, Homo sapiens
  ENST00000383721
gaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccaccaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtgagtgtctcattaactgtatcaagatgcttatgttatagaattttttaaacaaccttttgaaatataaatcacacataacaattca

SEQ ID NO: 13707 - DNA, 2276 bp, Homo sapiens
  ENST00000461689
aacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccaccaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagag

SEQ ID NO: 13708 - DNA, 355 bp, Homo sapiens
  ENST00000493199
gtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggtgcattacgtactcctaagagagaaggtggacagtctacatctggcaggcctaatgcagtaaaccttttaaatgtcagctccatttatttttgggacagggccagcttgttatatcttttcac

SEQ ID NO: 13709 - DNA, 631 bp, Homo sapiens
  ENST00000487068
gctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccagatggagtctcactctgttgcccaggctggagtgcagtggtgcgatctcagcttactgcagcctccccctcccgggttcaagcaattcttctacctcagccttctgagtagctgggattacaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtca

SEQ ID NO: 13710 - DNA, 582 bp, Homo sapiens
  ENST00000496822
atgcgcagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaaca

SEQ ID NO: 13711 - DNA, 2452 bp, Homo sapiens
  ENST00000535191
gaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccaccaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttga

SEQ ID NO: 13712 - DNA, 3329 bp, Homo sapiens
  ENST00000298925
atatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagcagaagatatgaagccacccgtgttatcgctgatatggagaactagagttctgaagtctctgcttcagcaatcccttcagggagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttttgtcccatctactgcatacttagtgctgagatccctgtaaaatgttttgatgaaaatatgtatgtagagtccagtcgcattatacatacatttcatagtgctgaaccttcttaaatgcctactcattcagcttaaacaggctgaagccaagtatgacaaagaggggaagggccaaaaacataatcaaagaataattttaaagagaattcttgtctctcttgc

SEQ ID NO: 13713 - DNA, 3022 bp, Homo sapiens
  ENST00000357134
tatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttt

SEQ ID NO: 13714 - DNA, 2400 bp, Homo sapiens
  ENST00000532434
tccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgacca

SEQ ID NO: 13715 - DNA, 582 bp, Homo sapiens
  ENST00000528046
gaatgttctttgaggcactctgacaagtaagacagaaggcagaggagtgcacaataaaggagcctctagacagccccggaggtaggaggacaacaggaagaatgcagtgtcaaaagggcagaatgtttcaaaaggaggcagagcacgactgtttgggaagttaccaagggttcacttagtggtcaggccaccgtctggccattaactttggcacaatgtagagaataagatttgtaagagtgggtggtattggtcagtgcagctaaaaatactggccagatatttctctccagactgagtccatcttaatcaccacagtacagagcctggcacagagaacatactccacaaatacatctttgaatggacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatggg

SEQ ID NO: 13716 - DNA, 748 bp, Homo sapiens
  ENST00000527873
gctggttcatcagggactgacattgcttcatgactcctggctgctgtggaaaataatttttcccctccttctgatagcaagatggagtctggctctctgtcacccaggctggagtgcagtggcgccaccttggcttattacaacttcctcctcccaggttcaagtgattctcctgccttagcctcccaagttgctgggattacagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatt

SEQ ID NO: 13717 - DNA, 556 bp, Homo sapiens
  ENST00000529595
tcagggactgacattgcttcatgactcctggctgctgtggaaaataatttttcccctccttctgatagcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatct

SEQ ID NO: 13718 - DNA, 256 bp, Homo sapiens
  ENST00000524738
ttgattcctagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacaggatttatgagcgtgtgatagaccctccagataccaaccttcccccaggaatcaatttatggcttggccagcgcaaccaaaagcatggcttattc

SEQ ID NO: 13719 - DNA, 486 bp, Homo sapiens
  ENST00000528495
aaagcacacacatttatgaacacccatgaggttcctgagttacagtttaatgtctcatttggtattcattagaccatgacagccaatatttcttcaatttagagtgattccaccttgtgtaaaaaaaataaaaaaaacaaaaaacagataatgctaagaatcagtgaactgctctgagcatttttttctcttctcagaaggattttttttcttgttgctattagctttgttaggatgatgcaattgaattacagaaattacattcagtaactcttgtttgcagctaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagt

SEQ ID NO: 13720 - DNA, 563 bp, Homo sapiens
  ENST00000530672
agagctaggaagttgtggtggtactgaagaagagggatgacgacagcctgaacaaagacagtgtctgggggcagaggcaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcacca

SEQ ID NO: 13721 - DNA, 1907 bp, Homo sapiens
  ENST00000529218
agagagaattatgacccaagcaagaatcatgggtccagaattccacccaaggaagctagttcaaagccagagaaagagcacagcttttcacacaattgaatagatctcaacttcatgattttggtattgaagatgctgacagtagccagtggctctgtgaaggcaattttccaacctaccattcttggctactcctgggatattttacttggctgtgagatccccctgagaagcttctctttttctcacacaattcctccatcagcgaagtgtggtgggcagcacacagtgactatgattcctggagatggcactgggactgaacttatgctgcctgtcaagattatgttcagacatgtgtgtgtgcctgtggactttgagggaatgtcagtgacctccacctctgcctcacatgaagaggaaattcataatgccatcatggcagttcattgaaaccgtgtggctttgaagagtagcgttaaaactgacgacaccctgccaccatcatacaaatccttcaacaacatgttgcataccaccctagatctctatgccagtgtcattcatttaaaaaatttgccaaacgtggagacctggcacaaagatgtagacatcctagttgtttgggaaaacacagagggtgagtatagcaatctggagcatgagagtgtgaaaggagtgacagagagcctaaagatcatgactaaggccaagtctttgtgcattgctgaatatgccttccagctggcccagaagatgggatgcaaaaaagtgatggctgtgcacaaggtcaacatcacgaaactgggagatggtctcttcctccagtgctgtgggggaggtggcatcccgctatcctcagctcaccttagaagacatgattgtggagaatgccacaatgcactttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggt

SEQ ID NO: 13722 - DNA, 1037 bp, Homo sapiens
  ENST00000534263
agcacagcttttcacacaattgaatagatctcaacttcatgattttggtattgaagatgctgacagtagccagtggctctgtgaaggcaattttccaacctaccattcttggctactcctgggatattttacttggctgtgagatccccctgagaagcttctctttttctcacacaattcctccatcagcgaagtgtggtgggcagcacacagtgactatgattcctggagatggcactgggactgaacttatgctgcctgtcaagattatgttcagacatgtgtgtgtgcctgtggactttgagggaatgtcagtgacctccacctctgcctcacatgaagaggaaattcataatgccatcatggcagttcattgaaaccgtgtggctttgaagagtagcgttaaaactgacgacaccctgccaccatcatacaaatccttcaacaacatgttgcataccaccctagatctctatgccagtgtcattcatttaaaaaatttgccaaacgtggagacctggcacaaagatgtagacatcctagttgtttgggaaaacacagagggtgagtatagcaatctggagcatgagagtgtgaaaggagtgacagagagcctaaagatcatgactaaggccaagtctttgtgcattgctgaatatgccttccagctggcccagaagatgggatgcaaaaaagtgatggctgtgcacaaggtcaacatcacgaaactgggagatggtctcttcctccagtgctgtgggggaggtggcatcccgctatcctcagctcaccttagaagacatgattgtggagaatgccacaatgcactttctgtgaagagggctgcagatacggtggaacgtgtgtggctcccaacaaatgtgtctgtccatctggattcacaggaagccactgcgagaaagtggtgagaatgctggctccatgaaagaggtctgcgagagcagggaccttgtttgctctccagggcttactgcaacagactggcacataagtgtctaataaatattccgacagaa

SEQ ID NO: 13723 - DNA, 3094 bp, Homo sapiens
  ENST00000325319
ggggctgccttcccgggcgcatatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttttgtcccatctactgcatacttagtgctgagatccctgtaaaatgttttgatgaaaatatgtatgtagagtccagtcgcattatacatacatttcatagtgctgaaccttcttaaatgcctactcattcagcttaaacaggctgaagccaagtatgacaaagaggggaagggccaaaaacataatcaaagaataattttaaagagaattcttgtctctcttgc

SEQ ID NO: 13724 - DNA, 7342 bp, Homo sapiens
  ENST00000339362
ggtcagcggctgcgcggccggccccctcccacgggagccgcgccagggcccagcaagagtcgggcgggatcgctattgtttttggcgagcacataaatccccgggccgacccactgcgcacccaggtttcctcccggaggcctttcggtttcctctgaggccctatatagaggctccaggcccggactgtgcagaggtgcgcgcccacgccggcctcccggaccagcctgagctcggagcgcctctcgccctcaggagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaa

SEQ ID NO: 13725 - DNA, 4315 bp, Homo sapiens
  ENST00000560262
gggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgact

SEQ ID NO: 13726 - DNA, 4441 bp, Homo sapiens
  ENST00000558964
gggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgact

SEQ ID NO: 13727 - DNA, 374 bp, Homo sapiens
  ENST00000558485
acagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaaggtaagtgttgtctgcctaaaagccttcttcagccttagcttgagactttgtca

SEQ ID NO: 13728 - DNA, 5895 bp, Homo sapiens
  ENST00000560328
ggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgatgttgccatcccaacattacctcccacttcactgaccagtgccactactgaccatctagcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatcc

SEQ ID NO: 13729 - DNA, 566 bp, Homo sapiens
  ENST00000560352
agcaaacggcgagactctgtgggcgtgggaccctctgagccagcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagta

SEQ ID NO: 13730 - DNA, 468 bp, Homo sapiens
  ENST00000560407
acggtgcgctgcacccactgacctgcgcccactgtctggcactccctagtgagatgaacccggtacctcagatggaaatgcagaaatcacccatcttctgcgtcgctcacgctggaagctgtagaccggagctgttcctattcggccatcttcactcctccccctgttgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagta

SEQ ID NO: 13731 - DNA, 459 bp, Homo sapiens
  ENST00000558807
cacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatggtaagaataacaattggcaagactggaacacaatagatactagctgtagtcaaatgagtcaaactggaaagccacagacttggggtggatatggctcaagtctgtgaactttagtgcatcacgctgctgttgttcctgtattgcatcgaggctgctggaatggattttttgcagtgccttgtagagaactgtcctttcaagcagaactagagcaaataaaaatgtgtatgtgcta

SEQ ID NO: 13732 - DNA, 1046 bp, Homo sapiens
  ENST00000560808
atgtttcactgttgaggctgctcagtggcatagggcacatgctggtaactaacctccacgtttaacatctagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcag

SEQ ID NO: 13733 - DNA, 543 bp, Homo sapiens
  ENST00000558886
catatttaatggcaaaagaaatgctaacatttagactttcctgctgtagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtgtaagttcgtggggccatcagtccagccagattgcctgggaacatgccccagggcctgagactgctggtcaagctgataatctgtgcatacca

SEQ ID NO: 13734 - DNA, 7088 bp, Homo sapiens
  ENST00000261908
gagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaac

SEQ ID NO: 13735 - DNA, 5558 bp, Homo sapiens
  ENST00000368223
gctactcccaccccgccccgccccgtcattgtccccgtcggtctcttttctcttccgtcctaaaagctctgcgagccgctcccttctcccggtgccccgcgtctgtccatcctcagtgggtcagacgagcaggatggagggctgcatgggggaggagtcgtttcagatgtgggagctcaatcggcgcctggaggcctacctggcccgggtcaaggcgctggaggagcagaatgagctgctcagcgcggagctcggggggctccgggcacaatccgcggacacctcctggcgggcgcatgccgacgacgagctggcggccctgcgggccctcgttgaccaacgctggcgggagaagcacgcggccgaggtggcgcgcgacaacctggctgaagagctggagggcgtggcaggccgatgccagcagctgcggctggcccgggagcggacgacggaggaggtagcccgcaaccggcgcgccgtcgaggcagagaaatgcgcccgggcctggctgagtagccaggtggcagagctggagcgcgagctagaggctctacgcgtggcgcacgaggaggagcgcgtcggcctgaacgcgcaggctgcctgtgccccccgctgccccgcgccgccccgcgggcctcccgcgccggccccggaggtagaggagctggcaaggcgactgggcgaggcgtggcgcggggcagtgcgcggctaccaggagcgcgtggcacacatggagacgtcgctgggccaggcccgcgagcggctgggccgggcggtgcagggtgcccgcgagggccgcctggagctgcagcagctccaggctgagcgcggaggcctcctggagcgcagggcagcgttggaacagaggttggagggccgctggcaggagcggctgcgggctactgaaaagttccagctggctgtggaggccctggagcaggagaaacagggcctacagagccagatcgctcaggtcctggaaggtcggcagcagctggcgcacctcaagatgtccctcagcctggaggtggccacgtacaggaccctcctggaggctgagaactcccggctgcaaacacctggcggtggctccaagacttccctcagctttcaggaccccaagctggagctgcaattccctaggaccccagagggccggcgtcttggatctttgctcccagtcctgagcccaacttccctcccctcacccttgcctgctacccttgagacacctgtgccagcctttcttaagaaccaagaattcctccaggcccgtacccctaccttggccagcacccccatcccccccacacctcaggcaccctctcctgctgtagatgcagagatcagagcccaggatgctcctctctctctgctccagacacagggtgggaggaaacaggctccagagcccctgcgggctgaagccagggtggccattcctgccagcgtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcaggatggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcccggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctgggaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcccccaggaggaaggggaggagagcagagaagagagcgaggaggatgagctcggggagacccttccagactccactcccctgggcttctacctcaggtcccccacctcccccaggtgggaccccactggagagcagaggccaccccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggccctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaa

SEQ ID NO: 13736 - DNA, 2357 bp, Homo sapiens
  ENST00000583169
gggtgtgatgcgagcgtcacggtggggatgctgctggctgcgcggcgctgagggccagcgagagcgagagcccgcccggggcggaggacggactcatccggatctggctgcagcgtgggctcggagctcccccttcctctcggtctccctctcggcccccctttatttccttcttgctttgcgtctttaacacctctcgaccctgtcctccccccgccactggaagtcttcccgtctctaaatggaattagtggagcccggagcctctggtgtaacgcacagacatgatccatgggcgcagcgtgcttcacattgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgatcctgactttaaggaccttggagctttgaaaccattaccagcgtgtgagtttgagatgggcggttccgaaggaattgtggagtctatacaaattatgaaggaaggcaaagctactgctagcgaggctgttgattgcaagtggtacatccgagcacctccacggtccaagatttacttacgattcttggactatgagatgcagaattcaaatgagtgcaagaggaattttgtggctgtgtatgatggaagcagttccgtggaggatttgaaagctaagttctgtagcactgtggctaatgatgtcatgctacgcacgggtcttggggtgatccgcatgtgggcagatgagggcagtcgaaacagccgatttcagatgctcttcacatcctttcaagaacctccttgtgaaggcaacacattcttctgccatagtaacatgtgtattaataatactttggtctgcaatggactccagaactgtgtgtatccttgggatgaaaatcactgtaaagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacagctactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaagatgaggaaactgaagagttttagtaacttttttaagattacacaataaacaatgatgaatcaagctttgaagccaacctcaccaaccacaagatcaaccaacactcttcaccaatgtgtaatataaccacgttaatattcaacatagtacgtactgctgaaagaagttgatacttattcatattaaccccgtagttttgtgtttcctcatctgtaaaagtatgtattataacaccttctctccaccttacagcgtgtgaggttcaaatgaccattcattggaagatattttttatatcctataatgcattataaaaataaatcatttttcctaaatcatgtgtagacttcattttatgatcgacatggaacaaaagtatcatctataaagagtaacaatgtagagtaacccccctcagaacttgtccaccataaaatatatgactttccaaatccaa

SEQ ID NO: 13737 - DNA, 629 bp, Homo sapiens
  ENST00000582281
ctagggtctagaaagaaaattcaagacagcttgagaatagtgcgttcctgaatgattttgaacatgctacagtgaaaagtgacagtgtggaccatggaatcaccagctagaggttatggactatacacacctattattatattctgattaaatacaggaaaaagtaacaagtaaaattactagattgcaataaaaaaattcattttttggtctttcctgtatacccctgatttcctttttgttttatatcaaagaaagtactgagtttcagaaatcctttttgaagtcaggtattttaccattcatactctacagtagaaatgtttttgattaagcactcagcaatatgaccaaattgacagtttgagaaaataccctgcatgtcagtactggatatttgagttgggaaaatatcctttttgttagacacattgtgaaaagcatgcattgtcaaatactgttgttactcttccatttctttatgtcatatgcttgctacttacgactttttatataaatatatataaaatgtataataatttcctaatttgagttaagagaaatgttttcttccattagagtgattaaaaaactgactcacataaatacacattttatgtcaactcttt

SEQ ID NO: 13738 - DNA, 3058 bp, Homo sapiens
  ENST00000327305
atgacggaccccttcttcctgccttcaatgcctcagcggaagatccccaagggctggagcgaggagcgctgccgctggacatcctcccggggaggctgctccgacctgctgcgcggcgcgtctgagactggggactgagccaccccgccgccgccggcgccgccgccgccgcccgctccgtcgctgccgtcggtctggactggcccccacctcgctgcgccctctccccggccccggccccggctcggggcgtcccggggctcgccctgcgaccgccgcctcccgcgcgccgcgtcctcccgaccccgcggcggcgacgatgcccgggaggagggtcctgacggcggcggcgcggatggtggcggccggcgcccgggtgtgatgcgagcgtcacggtggggatgctgctggctgcgcggcgctgagggccagcgagagcgagagcccgcccggggcggaggacggactcatccggatctggctgcagcgtgggctcggagctcccccttcctctcggtctccctctcggcccccctttatttccttcttgctttgcgtctttaacacctctcgaccctgtcctccccccgccactggaagtcttcccgtctctaaatggaattagtggagcccggagcctctggtgtaacgcacagacatgatccatgggcgcagcgtgcttcacattgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgatcctgactttaaggaccttggagctttgaaaccattaccagcgtgtgagtttgagatgggcggttccgaaggaattgtggagtctatacaaattatgaaggaaggcaaagctactgctagcgaggctgttgattgcaagtggtacatccgagcacctccacggtccaagatttacttacgattcttggactatgagatgcagaattcaaatgagtgcaagaggaattttgtggctgtgtatgatggaagcagttccgtggaggatttgaaagctaagttctgtagcactgtggctaatgatgtcatgctacgcacgggtcttggggtgatccgcatgtgggcagatgagggcagtcgaaacagccgatttcagatgctcttcacatcctttcaagaacctccttgtgaaggcaacacattcttctgccatagtaacatgtgtattaataatactttggtctgcaatggactccagaactgtgtgtatccttgggatgaaaatcactgtaaagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacagctactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaagagaagaactatttatacaaacatggggactgtgaaaagaaaattctatagtgaattgtgaaaagtggacatatttctaaattcattccactgcctttatccaaacttaagaattacagacatttgttattccttcggcaagacatccccgctgcacactgatatgttcatttcgtaatttggttgctggccaccaagtgctccttagtttttaaatacattttgagattaactggaaacttgaagaagaaattagttcccgattaagactatcccaactttatttttattgtcagtttcacttttgtttctatgttgttttatgtctttgttatataattgtacattgtgtgatatgtgaaaaaaaaacacgaatttggatgaaccttgtgttacatgtacattgttttcattatatagacagcttgagaatagtgcgttcctgaatgattttgaacatgctacagtgaaaagtgacagtgtggaccatggaatcaccagctagaggttatggactatacacacctattattatattctgattaaatacaggaaaaagtaacaagtaaaattactagattgcaataaaaaaattcattttttggtctttcctgtatacccctgatttcctttttgttttatatcaaagaaagtactgagtttcagaaatcctttttgaagtcaggtattttaccattcatactctacagtagaaatgtttttgattaagcactcagcaatatgaccaaattgacagtttgagaaaataccctgcatgtcagtac

SEQ ID NO: 13739 - DNA, 408 bp, Homo sapiens
  ENST00000579730
ctgtcctccccccgccactggaagtcttcccgtctctaaatggaattagtggagcccggagcctctggtgtaacgcacagacatgatccatgggcgcagcgtgcttcacattgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagatttacttacgattcttggactatgagatgcagaattcaaatgagtgcaagaggaattttgtggctgtgtatgatggaagcagttccgtggaggatttgaaagcta

SEQ ID NO: 13740 - DNA, 1849 bp, Homo sapiens
  ENST00000397929
acagccacactgcagtatgtcaggaacagtcatggagctgttctcattgtttgcctctccttttcctcctttttaccttctggcccctctcttcattcagagatgctggcagagccattccctaaggttgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgaataaaaggcaaactccttagcaggatctacagagtgtttcgtgatctctccttctccatcatctcatctctggatgctgtggtgcccagaacgttgatctaacaccatcttgaagcacacatgctgatctccaggtgcaccacgatttgtgcccttgaaaatgctgtttgctcaatctttctggagaaagtttgccacatattcggacttagtaaattagaactcctaccttgaaacccagatgaaggttcaattttccccaggattcctttcctcaccattctcctatgtgagggacttcttgtattataatcttttaatataatattatattttatgtaatattgtgttaaattatattgttttatgtaatatattattttaaatgttattttatatatgatattaaaagattataattatataatctttttcgataatttattcttgtattacaatctttttattataatagtctccactctccccaaaatattgtgaattcttcagctgaggagttttgctttagtttcttatcgccatggactgggaattaacatgtatttaacacattttgctcaaacaatcaaacagtaaaagctgaagagagcgtattattattcgcccattccgagagaaagttgaagatgactgaagaactaaaaatacataaatgaattaagtaattataaacataaatttcctgtagctccaacatgactttgatctgagtaatagtgttgtgaaatagattactacatgattttcattgcttttatattatatatagtaattaatattcagaatagttgattaactttcttaagtgtcacataatttaaaaatgaaattgctgtttgccccagatatgtttttctgtgttctttttaaatttcagtgaaattttcttatactcccttcattaaatctattatctggtttctaaacctttacctatttaatgtctcttttcctttctttctaaaaagtaactggttaaactacagttttgtcatttatgaaattttttctgttattattgtagggatagtcaatattatcattttaaggatagttaaaacttattttgcaattaatacgtattttacagtacactaatatgcatatatgttgtattttattaaaatattaaaatgttttttaaacaaaaatattgtccgaagctctaaataccagagtattgattttaaagtctgccaagacaataatacaagtaacacaactaagcctttctttaaataataaaacgagtatctaaa

SEQ ID NO: 13741 - DNA, 575 bp, Homo sapiens
  ENST00000579169
agtgcgcaggaaccccccgggggtggaggatagcgtgcagttcagggatggacacgtgcggcagagattggcccaagcgagggcgcaggtggaaagcgggagagcgcggatgatacctagtggggccagaggagtcttcctcttctaggggctcccggagctcggcgggcccctgttcgcagtacaggaggtagcagaaggcacacctgaagccagcgctggagggaagggcgagggtcagcttccacccctttccgccctggagaccgctgatgtcgctttatgggtttgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagat

SEQ ID NO: 13742 - DNA, 307 bp, Homo sapiens
  ENST00000577184
ccaagccatgactaaggagcccatttgatagcagaggtggcgcgcagcccggcgagccgatgacggaccccttcttcctgccttcaatgcctcagcggaagatccccaagggctggagcgaggagcgctgccgctggacatcctcccggggaggctgctccgacctgctgcgcggcgcgtctgagactggggactgagccaccccgccgccgccggcgccgccgccgccgcccgctccgtcgctgccgtcggtctggactggcccccacctcgctgcgccctctccccggccccggccccggctcgg

SEQ ID NO: 13743 - DNA, 2273 bp, Homo sapiens
  ENST00000407683
gttgtcgcggaggcctgcgtgagtgaggcctggcgtgccctggaaacattcccctgagttgaagaaagactcacagttttcagcatccagttaccctctgagcatcaggcagaacccgccggccccaaaaccaggcccccttggcacatgtgggcccgagtgagtccagcatgaggaggtgccgcttctgagcagagctcaggttgtctctgggaggaggagcgagcgttgggtgcggtggccgctgcgttggcagccctgtccctgagcggaacgcaggtcgtctctgggaggaggagcgagggttggacgcagtggccgctgcggtggcagccctgtccccaggcgtggactctgccctcagcttcacagtcaccgaagaaatgaagttacaggaggggcacaccgtccttttgtctctgcctttgaggttggcgggaactgaaactgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcggg

SEQ ID NO: 13744 - DNA, 860 bp, Homo sapiens
  ENST00000415936
gccgctgcgttggcagccctgtccctgagcggaacgcaggtcgtctctgggaggaggagcgagggttggacgcagtggccgctgcggtggcagccctgtccccaggcgtggactctgccctcagcttcacagtcaccgaagaaatgaagttacaggaggggcacaccgtccttttgtctctgcctttgaggttggcgggaactgaaactgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggcccc

SEQ ID NO: 13745 - DNA, 1907 bp, Homo sapiens
  ENST00000405370
agcttcacagtcaccgaagaaatgaagttacaggaggggcacaccgtccttttgtctctgcctttgaggttggcgggaactgaaactgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttg

SEQ ID NO: 13746 - DNA, 536 bp, Homo sapiens
  ENST00000476542
acagtcaccgaagaaatgaagttacaggaggggcacaccgtccttttgtctctgcctttgaggttggcgggaactgaaactgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcgggtgagtgagtggccgggggctctgtgtgggtgtagtggccggatctgctggggctgcacaccccgggatggggcgggggtggcggcggcaggcagatgcccgaggtagagatgagcaaaccaggctcagcgatcctgggtgccctgcggggggctgtgcccaggtccctggacgtcctggtcagcggaacttcctcctctgggcagtggggtgccctgcacgtgctggggacagcagccctggcgga

SEQ ID NO: 13747 - DNA, 2281 bp, Homo sapiens
  ENST00000435855
acagtcaccgaagaaatgaagttacaggaggggcacaccgtccttttgtctctgcctttgaggttggcgggaactgaaactgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggaggagaaggctggacgctgaggtgtctctcagctcccaaaccaacagccaccccgccccaccccttcctcttattctttactcccttctcaccctgcccagggcctggccaggcctcacccacaactttccctccaccccatcctctgtggccacctgaccccggcccgtgggagctacagcagggagtgcagcagacacatggccaacccagggaccccactgcagggcctcatgccccccgcctgccctccgctctctctgtgtgggcagcgctcaccagcctccctgggtgccgtccacctgggctcggctgctaagggctgtgagaggcttgttcagcctgggaggactcagggcggctgggatgagtcgtgtggaagggcggtcagagtgcgatggtcctaacccgaggcaccagcccctccttccccgtccccctgtgccttcctccagccccccgacctcggggacccagcagcccctcccacctctgccctcctccctgcagactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtg

SEQ ID NO: 13748 - DNA, 3013 bp, Homo sapiens
  ENST00000618597
acagtcaccgaagaaatgaagttacaggaggggcacaccgtccttttgtctctgcctttgaggttggcgggaactgaaactgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcgggtgagtgagtggccgggggctctgtgtgggtgtagtggccggatctgctggggctgcacaccccgggatggggcgggggtggcggcggcaggcagatgcccgaggtagagatgagcaaaccaggctcagcgatcctgggtgccctgcggggggctgtgcccaggtccctggacgtcctggtcagcggaacttcctcctctgggcagtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctcccgtcccagacaaatccctctccccaggactgttctgcgcctcccgtcccaggcaaatccctctccccaggaccgtcctgcacctcccgtcccaggcaaatgggtattgatcacccccagtcacccagtgggcaggagcaggccctctatggctgacccgactctctctcatcccccccgctaatctctttatctgcagaggagaaggctggacgctgaggtgtctctcagctcccaaaccaacagccaccccgccccaccccttcctcttattctttactcccttctcaccctgcccagggcctggccaggcctcacccacaactttccctccaccccatcctctgtggccacctgaccccggcccgtgggagctacagcagggagtgcagcagacacatggccaacccagggaccccactgcagggcctcatgccccccgcctgccctccgctctctctgtgtgggcagcgctcaccagcctccctgggtgccgtccacctgggctcggctgctaagggctgtgagaggcttgttcagcctgggaggactcagggcggctgggatgagtcgtgtggaagggcggtcagagtgcgatggtcctaacccgaggcaccagcccctccttccccgtccccctgtgccttcctccagccccccgacctcggggacccagcagcccctcccacctctgccctcctccctgcagactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgt

SEQ ID NO: 13749 - DNA, 753 bp, Homo sapiens
  ENST00000423583
cttttgtctctgcctttgaggttggcgggaactgaaactgattgaaaacagtgggcttgaaaagcctggagcagagggagtgaggcctgccccccaccccagctctgcgggcacaccctggccagacagccctgctccagacccggcctgtgtctcagggtggcccaggaggggactttgcaagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaa

SEQ ID NO: 13750 - DNA, 2352 bp, Homo sapiens
  ENST00000404257
attgcgatggggtgctggcctgccaggagcacagatacagagctagagcccagtgaggcctgtgctgtgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgccttgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcgg

SEQ ID NO: 13751 - DNA, 2526 bp, Homo sapiens
  ENST00000391969
gcgatggggtgctggcctgccaggagcacagatacagagctagagcccagtgaggcctgtgctgtgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgccttgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtg

SEQ ID NO: 13752 - DNA, 2288 bp, Homo sapiens
  ENST00000325935
gaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgccttgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggcccctgaggggggcctggtttttgcctgcctgtacgagagcggggccaggacctcctatgatgagatttccttttgtacattctccctgcgtgaggtcctggagaacgtgcccgccagccccaaaccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaggatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcggg

SEQ ID NO: 13753 - DNA, 451 bp, Homo sapiens
  ENST00000435934
gcccttgtctctgctctgggtcaggcgaggcagccacccatgatgagctctgcagccttcccaaggtggctgccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccaggcaggtcccgcctgcaacaagcagaccccatgcgtgccccaaatgccccctcacccgggccctgccctggtgggtgttgcctgggagcaaactcccagaatggccgccgggccccactcggctttggagcttctgattcctgtgggcgcttctcagagcatgggggtccctcgtaccccttcacggacagtgctcttc

SEQ ID NO: 13754 - DNA, 484 bp, Homo sapiens
  ENST00000435894
gtctctgctctgggtcaggcgaggcagccacccatgatgagctctgcagccttcccaaggtggctgccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccagcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagca

SEQ ID NO: 13755 - DNA, 676 bp, Homo sapiens
  ENST00000426032
gtctctgctctgggtcaggcgaggcagccacccatgatgagctctgcagccttcccaaggtggctgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccc

SEQ ID NO: 13756 - DNA, 845 bp, Homo sapiens
  ENST00000420288
tctctgctctgggtcaggcgaggcagccacccatgatgagctctgcagccttcccaagcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggtgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcagcggtggacggtgggcaggccggcagcttcctctactgcaatgcccggagcccactgggcagccgtgtgcaggcgctcagcactgacgagggcacctccttcc

SEQ ID NO: 13757 - DNA, 491 bp, Homo sapiens
  ENST00000494678
gtcaggcgaggcagccacccatgatgagctctgcagccttcccaaggtggctgccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccaggcaggtcccgcctgcaacaagcagaccccatgcgtgccccaaatgccccctcacccgggccctgccctggtgggtgttgcctgggagcaaactcccagaatggccgccgggccccactcggctttggagcttctgattcctgtgggcgcttctcaggtcagggccctgcaggtgggaagcaccaggcactggaatgagggcactgtggggccagctgcctgcaggcaggggtctgatcaccaagcacctgtcccctg

SEQ ID NO: 13758 - DNA, 541 bp, Homo sapiens
  ENST00000488997
acccatgatgagctctgcagccttcccaaggtggctgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcgggtgagtgagtggccgggggctctgtgtgggtgtagtggccggatctgctggggctgcacaccccgggatggggcgggggtggcggcggcaggcagatgcccgaggtagagatgagcaaaccaggctcagcgatcctgggtgccctgcggggggctgtgcccaggtccctggacgtcctggtcagcggaacttcctcctctgggcagtggggtgccctgcacgtgctggggacagcagccctggcggagcaccggtccatgaacccctgccctgtgcacgatgctggcacgggcaccg

SEQ ID NO: 13759 - DNA, 505 bp, Homo sapiens
  ENST00000428592
acggtgctgtggcctctattctggggacactgagctcctccttgctcgaggttttgggtcctcattgtccacatgacctcctgctgggcgaattctgggatgaccctgtgtcctgggcacatggctggcagggtcccgggggctctctggccagcctcccctgcaccctggcaccaaccagcctggccgaggagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcg

SEQ ID NO: 13760 - DNA, 2273 bp, Homo sapiens; identical to SEQ ID NO: 13743
  ENST00000630923

SEQ ID NO: 13761 - DNA, 860 bp, Homo sapiens; identical to SEQ ID NO: 13744
  ENST00000626222

SEQ ID NO: 13762 - DNA, 1907 bp, Homo sapiens; identical to SEQ ID NO: 13745
  ENST00000621851

SEQ ID NO: 13763 - DNA, 536 bp, Homo sapiens; identical to SEQ ID NO: 13746
  ENST00000626675

SEQ ID NO: 13764 - DNA, 2281 bp, Homo sapiens; identical to SEQ ID NO: 13747
  ENST00000629521

SEQ ID NO: 13765 - DNA, 3013 bp, Homo sapiens; identical to SEQ ID NO: 13748
  ENST00000629786

SEQ ID NO: 13766 - DNA, 753 bp, Homo sapiens; identical to SEQ ID NO: 13749
  ENST00000625452

SEQ ID NO: 13767 - DNA, 2352 bp, Homo sapiens; identical to SEQ ID NO: 13750
  ENST00000616490

SEQ ID NO: 13768 - DNA, 2526 bp, Homo sapiens; identical to SEQ ID NO: 13751
  ENST00000618866

SEQ ID NO: 13769 - DNA, 2288 bp, Homo sapiens; identical to SEQ ID NO: 13752
  ENST00000626600

SEQ ID NO: 13770 - DNA, 451 bp, Homo sapiens; identical to SEQ ID NO: 13753
  ENST00000627618

SEQ ID NO: 13771 - DNA, 484 bp, Homo sapiens; identical to SEQ ID NO: 13754
  ENST00000629646

SEQ ID NO: 13772 - DNA, 676 bp, Homo sapiens; identical to SEQ ID NO: 13755
  ENST00000627724

SEQ ID NO: 13773 - DNA, 845 bp, Homo sapiens; identical to SEQ ID NO: 13756
  ENST00000626195

SEQ ID NO: 13774 - DNA, 491 bp, Homo sapiens; identical to SEQ ID NO: 13757
  ENST00000631177

SEQ ID NO: 13775 - DNA, 541 bp, Homo sapiens; identical to SEQ ID NO: 13758
  ENST00000626326

SEQ ID NO: 13776 - DNA, 505 bp, Homo sapiens; identical to SEQ ID NO: 13759
  ENST00000625706

SEQ ID NO: 13777 - DNA, 2934 bp, Homo sapiens
  ENST00000583458
gttgaaattctgcctctgagaagctaacagtcttcctgtggtcgccactcctccccagcagccccctccttgccaaggacggtccagaaggagccccactggggcctccccgctcagcaaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggcactggagcaaacgcttgttaaaatgccagtcccatgggcggggctggcaccgtgccccctccctcctcagcagacaccggagccggcctaccccacctctccagcgttcccaccactttcttgtccgtttgcttccagggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaacaaaaaaaacaaaaaaagatgttaagatccaagcaacaaaaaaaaaaccaaccaaaccaagaggcatccaaccaagtccaagtcccgcgtcctggccacacgcccgcaccgagggagcacgccggcaggggcgccgaggagcggccccaggacaggacggccccaccgcgtcctggctggcagcacagtgggaacacgcccctccgtctcaggcagtgggggagttggaggggaaggggcctcccttgtgggacccgtggggggctctgttttccatccagtcttcctttcccagcccccaactcccaagacagacagtgtggagcccagcggcggcggagcaggcccgggcctgagcaggcaggcgctgctagcaagacttgatctttgtggccagctgtgccagggggccggcggggctgaggggtgcgggcagctttcatcccaggggctccactgggccccgtcaccctcctgtcgcgtcccctgcgtcccacctccctcctgcccggcagtcccgcccgtgcccccagcctggcgaggaagccgtccaacagtagccccggggccagctcccaacagaaagggctgacgtggctccaggactcaggggcgctccatgggaggacgaaggaagcccagccagccaggagccactcctcacacctccaagtgtggccaagtgggccctgaggccaaggacttacttgctcttcctggccatctctccctttctggaggaggcccggggcctgtgtacaccaaggctgacctcgtgctgcctgctgggacccagccctccctgccgctcccctgtgagcccagtccaccgtgggcgcccagggccagggacgggccagcgcccggctgcatcgcgaggttgggagtcacagtggctgtgggcctggacgggcacagccagagcaggggcccatgggaagggcaagggatggggaagcctgggccggccccttccctgctcccaaggcaggtgtccaggtggcgggagcagcaccaaggacagccaggcttacccggtgggaggagcaggagcagagcaggtggcagggaggaacccctggcgaggcagggagcactgaagtagggaagcagcaaaaaatacaggctcccaacgtggctccactgtctcatgaagtgtcaaaaatttaaaaatacacctcactttctattcagcatcagctattgaaatggaattctccttttctattcccgttgtacatagccccacgccctgcctccggctttgtcctctgtacagagccccctgtcccctctgctgttccggacccttttcttgcagcagctcaaccccccgactcactcagatccccaggactgcagccgagccccgggcttcctttcttaccattctgtatgcttccaaggtgtgaccattcaaactaacagtattattaagattattaataaagatttctttcttcaaaccagga

SEQ ID NO: 13778 - DNA, 1143 bp, Homo sapiens
  ENST00000582043
agagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggcactggagcaaacgcttgttaaaatgccagtcccatgggcggggctggcaccgtgccccctccctcctcagcagacaccggagccggcctaccccacctctccagcgttcccaccactttcttgtccgtttgcttccagggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaacaaaaaaaacaaaaaaa

SEQ ID NO: 13779 - DNA, 1201 bp, Homo sapiens
  ENST00000581393
ctgtgcctctccagggctgtttcttcatctgcaaaatggggagggtgtggtggctcactgggcagggaggaccccgtgagtttcgaacagtctgtgtggctcacacacagtgttgaggaaaaccagcccatccttattatcattcccagtccaaatgccctttcctcctcgacctgctcccaggccaccctcccggacagccgctctgggggaagatgaggacgggaggaaagtgagagcaggactcagcacggggaagagggagcaggacggggactttggcaggcagtggggagagcttatgggcagagtccaagcgcctttcctgcagcctctggccacctggagctcggatggtggggctgtgctgagtctgactccagaaaccctcatcccagctgtgctcaggggggtagataacaagttccactttccctctccagttctcttctgggaggtgggtaccccaggcttcgggggatgacgcccaggggtgagggttgctcaggggcaggctgaggaggatcacaattgggaaagaatcctagcagacccccaggcagaagagtcaggaaggagtagaccctggtgttttgaactcagcacttgtccgggcagtgtgggaaaggggggcccggcgcggggaggcgccctgggaatgttcccaagggctccaccggtgtcgctggggttcccaggcatacgttttggtgggaaaagggtcggggaaggcagtgactaggtctctgtgcctttgttttaggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaac

SEQ ID NO: 13780 - DNA, 1519 bp, Homo sapiens
  ENST00000580155
gatacagcagcagctggtgctcctggccaggctgtgcgtgctctctctgcctctctctctcggactctctgctctctctctctgactctctcctctctctctgttggcctggtgaaatgttcttggctgtaggcacacagagccttggactcaaggctgttggagtcgaggacaccttgacttcggtcctggaggttgaaattctgcctctgagaagctaacagtcttcctgtggtcgccactcctccccagcagccccctccttgccaaggacggtccagaaggagccccactggggcctccccgctcagcaaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaac

SEQ ID NO: 13781 - DNA, 3072 bp, Homo sapiens
  ENST00000578998
cttacacatctcaaattctttttaaaaatttgggagtgttcccactttgcaagcatcccgagtgcgtcctgggtgtgactcttctgtgatctggcacttggcacaggaagtaaaagcggtagacatttttatagggtacaggtgatcaaccagcggggctgcaaaatctctggaaccagctgcccactctgcacccaagggccacacccaccgctgtctgggcagaagtgagaattcaggggagcatggaaatcagaacagacccatctctgaatggcctcgggctatgcggctcatgaggggcacggaacctacaccagtgaaacatcagggaatggagggaggtgggaacctttgcccacctttgcagcaagagccgtttcatctcaatctcttcatcagcctgggcacagagggctgcagtgggacggccctgggttctctgcaggttggcaccgaagccaacccatgggctctggtggcgagtgctgcgtgacttggcttcaacactacccaacactctggaattcatcagttgggggtggaggtttccattgtagaaaacaaacccaccaggtttgcccaggtgttaactatttacggtagaaacaggccagccaggcagtctcaggctgtctctgccatctggggttccagacagtgaaatggaggcagcagagacaggtggaggctcccagagaggcagaattgacaggggagggcacccaggaagccagaatcaccggtggaggcatccaggaagccagaattgacaggtgaaggtgcccagggccatctgaagcacacatgcagcctccaagtctcactcgcccagagtggacccagaagagtcactggatggagccccggggagtctgggcttggggtcagggtctccaggactctgctccatcatgggccttctagtaagaagagtcagttcttcggactggaggtcttcccagaaaacaaaacatttctttcagcctgatgcagtggctcatgcctgtaatcccagcactttgggaggctaaggtggcaggatcccttgagcccaggacttcaagaccagcctgagcaacacagggagaccctgtctctacagatagtttttaaaattagctgtgggtgtagtggcaggcacctgtggcccaagctactcgggaggctgaagtaggaggatcgcttgagcccaggaggtcgaggctgcagtgagccgtgatcgtccactgcactccagcctgggcaacagagcaagaaactgtgcccccctacccccaaaaaaagtttcttccttcctaacctgggatttatctttttggaagattccaaagtcccagcaatggcgtccagacacaaggttgtgtgatggtgggccggggatgcggggtggggtgaagacttggccagagggaggaacataccccgaccctccgtcctcactgcctccagtctgcctgccctgcagtggggttgttagaatctgggtcaggggttcacacatggcctgggcccactgccaccctctccagatgtatctccccagctggccagtgggctctcgtccctgctgttcctccccacccagtgcaaagggacaaggagccgggcccacggggcatgctgtagagataagacctgggtacactgaggaggggtaaggggctgggcctcgtcaagaagccctcctgcccaacctgtcggaatgcctggagccggagcccactgcaaggcagctggtgtcccccgcagaggcctccaggtggagcaggtctttgctctgctcctgggttcccccggggagaggaagactggcccacctgcaggaagggagaggctgggatgccgattacaggctgggatccctggctctgccactccccagctgctgacgggaggttgctgtgcctctccagggctgtttcttcatctgcaaaatggggagggtgtggtggctcactgggcagggaggaccccgtgagtttcgaacagtctgtgtggctcacacacagtgttgaggaaaaccagcccatccttattatcattcccagtccaaatgccctttcctcctcgacctgctcccaggccaccctcccggacagccgctctgggggaagatgaggacgggaggaaagtgagagcaggactcagcacggggaagagggagcaggacggggactttggcaggcagtggggagagcttatgggcagagtccaagcgcctttcctgcagcctctggccacctggagctcggatggtggggctgtgctgagtctgactccagaaaccctcatcccagctgtgctcaggggggtagataacaagttccactttccctctccagttctcttctgggaggtgggtaccccaggcttcgggggatgacgcccaggggtgagggttgctcaggggcaggctgaggaggatcacaattgggaaagaatcctagcagacccccaggcagaagagtcaggaaggagtagaccctggtgttttgaactcagcacttgtccgggcagtgtgggaaaggggggcccggcgcggggaggcgccctgggaatgttcccaagggctccaccggtgtcgctggggttcccaggcatacgttttggtgggaaaagggtcggggaaggcagtgactaggtctctgtgcctttgttttaggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggc

SEQ ID NO: 13782 - DNA, 877 bp, Homo sapiens
  ENST00000582880
gggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatggctagcctctgccgaggagggtacagccgcttcaccccctactagcaagagacccagcccctaacagcattcacactgactgcctattacacaccaaacccaacagcccaaaaccaggcacagccaccagaagacagtgcacccctcccggtcagcgacacgcacggctggccccctgcaactctaaaatctatagattatttctctccagccagttggtctccccaccccacctgtgctggtgtgtgtgtctttgaccctggtttttcctgtatgtctgcaaccgtgatttcctattttgactttgttgatgttgtactacccaagccattgcaggtacggtgtgcacaccgtggggtccaggctgggccaggagaccaggcagcccccaacctgggagtagcggtagcgccctatgagggcaagagccacatttcctggcctcccaggctgcacagaacaacagaaacgcctggcagggcctcccccaaagccacccgaccagccccgtgccatggccctagtgtccagcaccctgacgcagggagggaggggctccaggcacccagtgtgggtctccccggcctgagggtgctcccgcaggccttcacccagccaaccacaggagtagccactgcccctcctcgccccattcagctgaaactaatatttttcattaaattttattgacgata

SEQ ID NO: 13783 - DNA, 611 bp, Homo sapiens
  ENST00000582894
ggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatggctagcctctgccgaggagggtacagccgcttcaccccctactagcaagagacccagcccctaacagcattcacactgactgcctattacacaccaaacccaacagcccaaaaccaggcacagccaccagaagacagtgcacccctcccggtcagcgacacgcacggctggccccctgcaactctaaaatctatagattatttctctccagccagttggtctccccaccccacctgtgctggtgtgtgtgtctttgaccctg

SEQ ID NO: 13784 - DNA, 1547 bp, Homo sapiens
  ENST00000584778
agaagccgagggatgcagccaggggcacctcgcatggacgcctgccgcccgcctcagccctctgccctggggacacatggctgtgctggcagcagcaggttgaaattctgcctctgagaagctaacagtcttcctgtggtcgccactcctccccagcagccccctccttgccaaggacggtccagaaggagccccactggggcctccccgctcagcaaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatggtaaggagcccaggcccgcccagccctgggtgccagtcctaacagctgggcatgggtggtgaggcccttgggggagaggccgagccctctgaccaatgccttggtcccggagactttggaaggaccacggcctggatgtgagttagggtgaggggagggctggcccctcacgccctctcagttgcggggaagca

SEQ ID NO: 13785 - DNA, 260 bp, Homo sapiens
  ENST00000580508
ggaggaggagagagaccgggagggcgcccgggaggcagggcgcgcgcacactccgagggacgcagcgagcgcagagccgccgccgggcgcccccctgccgccccatgctgtgctccatggcgaactcgggctgcctcctgctgtccaactccggcagcatgctcccgcactccgtgccctgcccgcccgccttcctctacctccaacagagcgatcaggacgccacggctccgcctgaagcgatggcccagccctacccc

SEQ ID NO: 13786 - DNA, 154 bp, Homo sapiens
  ENST00000582139
agatgaacagctgaccgtgttttcaaagataccacctggggaaacagccagaagctggaagtcatcccaagagagaagtcagccaggggttggagaccccagcagaagagcgatcaggacgccacggctccgcctgaagcgatggcccagccct

SEQ ID NO: 13787 - DNA, 2694 bp, Homo sapiens
  ENST00000578887
gtgagcaggagacagggagggctgaaggctgtgcagcaccctggtatggggtgagtgagggtgcctagagggcgcccacagaaggggctcctgactcggactgaggggcagggaggtctccttggatgaaggggtgcctgggctagggctgcaggctggctggcccttgccaagagaggacaagagggagccattccgtgtagagggcatagtggctgcaaaggcctcagggagctgagggcatgtggcgtgctctgggtagcacatgactgagtgtgcgcctggactgggcatccgggatggggtcaccaagagcctcgtggacgatggagaagttgcaaggggatttgctgatgggcagccctgcccagcagcgactccactgggcttgttccttgtccgttccttgaacaacttgaagtcacagcagccagaggaaattctgccaccattttcccaggtctgcagcccctccagctgggaacctgctcctggagccatccctctgcaaacagagagcccagagtgcctcggggaaaattggctgaataaaaggtataaagactttctctatttttcctgaatagtttttgacagatatgagcatgttgaacatcttgggagctgctgataatgaaagccaggagtttctggggtttcccagccactggagggaggaagagtttgggggctgtggagggaaggcttggcgccgtttagcacctctgtgtcgtgttctctcttgtcccccatggatgagcccaaaatgtgctgggaaaggcaggactgggagccggaggggctgaaagggaaatggataaatggggtaaggatggaggacgattgtttttaggcaattctggctggcctgagaagcaatgtcactgccttcctgatcctttccctcccccaaccccaaggtcccccaccccaggtgctccgcgcatggccacccattcctcaggcagccccagcttgctggtccagggtggtccaactcatctccatggcctggtctcctcggggaaggggcttcggataccagctcagttcccagtgttgaccctcgctgggggactggctactactgcctgagcccattggtccattgctctgtacctccaacccccattacccacctgtggctgaccccctccacagattcacttgcagagtttactttggggagattattatacaagtatgatgcttctggaccttcaatggggttgtgtcctgataaacccatcataaggtgaaaatattgtaagtcaaaaataaatttaatggaccgggcttggtggctcatgcttgtaatctcaacattttgggaggccaaggtgggcagatcacctgaggtcaggagttcaagaccagcctggccaacatggcgaaaccctatctctactaaaaaatacaaaaattagccgggcatggtggcgggtgcctgtagtcccagctactggtaggccgaggcaggagaatcacttgaacccgggaggcggaggttgcatgagctgagatcacaccactgcactccagcctggtcaacagagcaagactccatctcaaaaaaaaaaaaaaaaaaaaaaaaaaaaagcacttaatgcccccaataaacccaacaaacataaagttgaaaaattcaaagtcaatcgtaagtcaaaccttcgtaagttggagatcatctgtaatgtatatttagtgtgaacaaaattagaaaatgcagccatcggccctcaggtggcctctcttcgctaggtcctgggttttgggtggtgtgtgcacaaggccagcgctgcgtttttcaaaaatcaggaccggaaactagatccgtcagcgtatgaagtcttcttcagccaaaactagaaaagttgggcactcttttttgtaccgcgtttgccctaagcccgcccttggctcagaagtgggcactgaccagatggcctggagctagacctgacattagaactagacctgggctagacctgagccgggtgcttccgtcctagaagcaggtcacctcggagccactcagggctgcgggcagaggcagctcgggctctgctgccggctctccggctttctagcaggaagaggacaaagagacagagcccagggggtccccttcacatggcctcaggcttcccacagtgggccgtgtgtaacagggtcccccgtaccgagtggctgcctgtgtgtgtcagggttagatgcagttttccgtgggagtagacaggaaggccgccgggtgttggcctcacaggcgcccgcaagtgttcaccacgaggagggcagcagccgtcacagccgcctcctgagatgccaccgctgtaaactgaatctattttacagggaagcatcggaaggagcccccaggtgagtcacttgtagaataaagaattcatttgccgggccgggcgcggtggctcacgcctgtaatcccagcactttgggaggccaaggcgggcgtatcacctgaggtcaggagttcaagaccagcctggccaatgtagtgaaaccccgtctctactaaaaatacaaaaattagccgggcatggtgacaggcacctataatcccagctacatgggaggctgaggcacgagaatcacttgaacccgggaggcagaggttgcagtgagccgagattgcaccacttactccagcctgggcaacagagcaaaactccgtct

SEQ ID NO: 13788 - DNA, 321 bp, Homo sapiens
  ENST00000582344
cagcttgaagtcacagcagccagaggaaattctgccaccattttcccaggtctgcagcccctccagctgggaacctgctcctggagccatccctctgcaaacaggtgtcctctcccggagaagctagccacaactctcccagcaccgcctctgtgctttctgtgctcgcccatcgtgaagccagcctatgcctccagtctcttctctaccaggagggagcagctaaaagctgagatttgttgcaatttacttttgtcccccacccatgccttcacagtgcccggcacttatttggtgtttaataaactgcccattaaatgc

SEQ ID NO: 13789 - DNA, 2934 bp, Homo sapiens; identical to SEQ ID NO: 13777
  ENST00000583458

SEQ ID NO: 13790 - DNA, 1143 bp, Homo sapiens; identical to SEQ ID NO: 13778
  ENST00000582043

SEQ ID NO: 13791 - DNA, 1201 bp, Homo sapiens; identical to SEQ ID NO: 13779
  ENST00000581393

SEQ ID NO: 13792 - DNA, 1519 bp, Homo sapiens; identical to SEQ ID NO: 13780
  ENST00000580155

SEQ ID NO: 13793 - DNA, 3072 bp, Homo sapiens; identical to SEQ ID NO: 13781
  ENST00000578998

SEQ ID NO: 13794 - DNA, 877 bp, Homo sapiens; identical to SEQ ID NO: 13782
  ENST00000582880

SEQ ID NO: 13795 - DNA, 611 bp, Homo sapiens; identical to SEQ ID NO: 13783
  ENST00000582894

SEQ ID NO: 13796 - DNA, 1547 bp, Homo sapiens; identical to SEQ ID NO: 13784
  ENST00000584778

SEQ ID NO: 13797 - DNA, 260 bp, Homo sapiens; identical to SEQ ID NO: 13785
  ENST00000580508

SEQ ID NO: 13798 - DNA, 154 bp, Homo sapiens; identical to SEQ ID NO: 13786
  ENST00000582139

SEQ ID NO: 13799 - DNA, 2694 bp, Homo sapiens; identical to SEQ ID NO: 13787
  ENST00000578887

SEQ ID NO: 13800 - DNA, 321 bp, Homo sapiens; identical to SEQ ID NO: 13788
  ENST00000582344

SEQ ID NO: 13801 - DNA, 4314 bp, Homo sapiens
  ENST00000369780
cgaacgcccacgccagcgaccctgactctatggccccgggggagcgcgccggagccgccgcgccgcccacccccagccggaaccctagcgtcccggggagcaagcggggagccccgggcgtccccggccccggcccagggccctgcttgtggcccccgctcccgccacggggcatgggaggcaggtagcccagcctgcgccaggacacccgtggcgggcggaacccgccaaggaccgcgaagtccagagaaaggaagctgaggagctgcccgcccgcccccggctgcagccccagcagggccctcccccggtggcgcgcacccgcgcgcgcacactcgcacaccgcacctcagcgcctgcccggcctcgcccccacccgcgagcgccgaacctcctggggccggatgccatgggtaacaacttctccagtatcccctcgctgccccgaggaaacccgagccgcgcgccgcggggccacccccagaacctcaaagactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaactggaactccataaggaggggccaaattgggaggccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctga

SEQ ID NO: 13802 - DNA, 746 bp, Homo sapiens
  ENST00000437579
gggggcgcgggaggggcctcggccctgccatgccggtctccgcccgcgggggaggagacgggggaggaggaggggagcagccggccggggcgactcggtgaccagccggccggcccagcagaggtggctgcactgcccgtcgccggagatggggggacagatcacccggagcactctccacgactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttg

SEQ ID NO: 13803 - DNA, 628 bp, Homo sapiens
  ENST00000455386
ggtcaggctggtcttgaattcctgacctcgtgatccacctgtgtcggcctcccaaagtgctgggtttacaggtgtgagccaccgcgcttggctgattgtattttctttagggccttggactttcggcttgattcgggccaaacattttggattgctgcgttaaaactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaac

SEQ ID NO: 13804 - DNA, 447 bp, Homo sapiens
  ENST00000465048
cgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttggtctggatacccgacaagagcggggacagtggccctcctgtgccttccagagtcgagcttacaagagctcaaggcatcaaggatcaactgcacatgttgggcacagataggccaccagggccccagcagtgctggtacaaggaagaggggcagtgcagcgcccaggatgccagattcagtggggaaggtcggtctgcctgccttatagttccccggaggctcccgagggctttgtctggttcagttattcctgtgcactctagttttctaccacaatgaatatatatcaagttgaaccata

SEQ ID NO: 13805 - DNA, 578 bp, Homo sapiens
  ENST00000496876
atataacctgagcgcccgcgcggccacgacacgaggaattcgcccacgcaggaggcgcggcgtccggaggccccagggttatgagactatcactgctcaggacctactaacaacaaagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttgg

SEQ ID NO: 13806 - DNA, 2852 bp, Homo sapiens
  ENST00000295108
tgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtga

SEQ ID NO: 13807 - DNA, 2131 bp, Homo sapiens
  ENST00000297142
agtctaaccttctgtgttgatgcatgaaggctggtacccacttacagggatgccagatgatcagtgcagaatgaaggtcccaagagagaggatcacatggctctctctgccctgtgacgtcactagcagatggcatgggtaccagctctggcagttggcatcaatgtcactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccaggagtttcctgatgggtcagggtggggaggctgcacaccacacaaggtcaccctactctaccttctacccaccctaccacagccctgagctcaccactcccccagggcatgggactcttgataattccaagtccatgaaaccctacaattattgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcagggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatgagaacttcttttcctttccttttgtctgtgaagcactgtgattctgtttctactggaaagatttttttctttttaattttcttttaaacttatttaatttgtttgaacaaggtgtctaagaatatactgttgaataaagacatgcacacagcataattcaatgtctattttggttgtacagtaattataaaatgcatgttattaaaaccagatgagtaaaatgatgtgtttataattattaggaattatatattatgtatcttttaaaaattgaaattttaaaatatggagaatatcactaagctgacaatgatattgggagatgaatttgcaacaatataaaaagctatgcaattttctttttattaaggatgaatctaaatgcattcaattggtaactattcctcttcaagtatttgcagatggggcaacatgatatttgggtagctgatgtcataattcggggacaattatctcaatcatcaagaaaaaaatttcagcacttgttttgtattattcagaaattaactgtacaggtttgttatcacaatgtataattgtgtttttccaccccacatttttaaggcaattaaatatagatatttccactcgtaaaggac

SEQ ID NO: 13808 - DNA, 1263 bp, Homo sapiens
  ENST00000401035
ggaacagctgcagccggcgctgggcccgcctggaatgcgggaacaggctgcacaccaggacttttatggaaacttgctgctggagacggcggcggcggcggcggcagcggcagccagaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaa

SEQ ID NO: 13809 - DNA, 2607 bp, Homo sapiens
  ENST00000334785
agaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgttt

SEQ ID NO: 13810 - DNA, 1456 bp, Homo sapiens
  ENST00000440324
cggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaa

SEQ ID NO: 13811 - DNA, 2712 bp, Homo sapiens
  ENST00000342754
ctgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaactgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaa

SEQ ID NO: 13812 - DNA, 859 bp, Homo sapiens
  ENST00000464998
acgaccatctctcaaggaagcaaagtgtctttcattagttatggtaaatttttgtttgtttgttttctaagaaacaaatcaaggcagtttaagttagcagcattttcctttatgactaaaaggtgggttttcataacgttttcttaggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaa

SEQ ID NO: 13813 - DNA, 1972 bp, Homo sapiens
  ENST00000480732
gtaatttatccaggaataagtattgtaatttcataccatagcttagttcatgcatatgtaaaatttaaaaatttcaggcaatctttgaattgtaaaccacttaaacattgtttctgagttgaaatagttctgtggtaaagcctggattaccttgataaaacttggagcaaatgaataataccccttgcctctctcattcccctgtgtgtatttcaaccacagagtcacagttcaggccagagggttatgttataccgcgcccggcctataatcttttgttttttttgagatggagtctcgctgtcacccaggctggagtacaatggtgcaatctcggctcactgcaacttccacctcctgggttcacgtgattctcctgcctcagcctccccactacttgggaggctgaggcaggagaatcgcttgaatctgggaggcagaggttgtagtgagctgagatcacatcattgcactccagcctgggcaataagagtgaaactccatctcaaaaaacaaaaacaaaaactaaaaacaaacaaaaaaaagaaatcccagtttcttcaagaaatagtccctttttagtatgtgtaattctggccagagtgataaaataattattttaaataggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttccc

SEQ ID NO: 13814 - DNA, 791 bp, Homo sapiens
  ENST00000470735
gcattctgacctttttcagttaagtgctatcaaaaccaagcagagttggtaggacaaacaggctaggatcccagtgatattgtgatctttacatttggagaaaaagtctataactaagagaatgcttcataaatgtatctatcacttttcctgaactggagagttagaaaaaatctgagtgtctgcagtgtagcaaaaatatgcattataaacatgttaatcattttgtgcttctaaacacctttagaactagtaacgcttctttgtttttagaaggcaagcaattgttaatcttggcccactttcttgcaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggaga

SEQ ID NO: 13815 - DNA, 3195 bp, Homo sapiens
  ENST00000330010
aacagctgcagccggcgctgggcccgcctggaatgcgggaacaggctgcacaccaggacttttatggaaacttgctgctggagacggcggcggcggcggcggcagcggcagccagaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtattt

SEQ ID NO: 13816 - DNA, 5602 bp, Homo sapiens
  ENST00000329021
gtgaactaaagagtcgccgcagacaagcaggcccccagatggagaaccagcctgtgaggtggcgggccctgccaggcctcccacgccctcctgggctccccgcagccccctggctcctccttggcgtgctgctgctgcccgggaccctgcgactggcaggaggacagtcagtgacccacaccggcctgcccatcatggcctccctggccaacacagctatctccttcagctgcaggatcacctatccatacactccccaattcaaggttttcacagtcagctactttcatgaagatctccagggacagaggagccctaagaagccaacaaactgccaccctggactgggcacagagaaccagagccacaccctggactgccaggtcacccttgtgctgccgggagcatcggccactggcacctactactgctctgtccactggccacactccacggtgagaggcagcggcaccttcatcctggtcagagacgcagggtaccgagagcccccgcagagtccacagaagctcctgctctttggcttcaccggcctcctgagtgtcctgagtgtagtgggcacggccctgctgctctggaacaagaagcggatgcggggtccagggaaggaccccaccaggaagtgcccagatccaagatctgccagcagccccaagcagcatccttcagaatctgtctacacagctctgcagcgccgcgagaccgaggtctatgcctgcatcgagaatgaggatggcagctcacccaccgccaagcagagccccctctcccaggagagaccgcatagattcgaagatgatggcgaacttaacctggtctatgaaaatctctaggatgggctccaccgctcatagagcttgccctgggtcagaggaccggggcagcccctgccaccaaaggacttgatctgagttgggagtaaggcccccagggacaccccatcatttcaccctcacattcaaggcccttcctgtcttggccggccccactgcccccccattctatgccccaaccaccaaggctttcccatcttggggcctttgcccaggctgttccttctgccaggcaggcccttcctcccttggcccaaccagcaaagcgcccctcagtcttcaagggctttcctggatgccacccttgcccagagccctgctcactgcctcatgctgacagagcagcatgctctcttggcaccagcctgcacctcagccagtagggcagcctctgagctgagggaggaccctgcaggggcgcctagcagtgctgtgtggggagccgaggtatggaggagctggggagcagctatgcaaatccctacctacccagctgggccagaggcacgaggcagccaggcagggtgggagcaggggctggcgtgggaggtctgggggacagacaaggatgatggacccctcagaggcaagactaggatcagggacagatctggaggcccaggacatggctgagaggtggtcagcaggctgggggcatggagcagagagggcttgggtacaagctggagaggaaggagattctggcatgttggggtgagggcagagggacagatgaggggaggagggtgctggctaaacaggaactgaatgaatggcctgaagctccctctcccaagggttcccactcccattggcctggccctgtacgtgcactctgtcatctccttggtcaccctctgctccaggccttctccaccacaggacctcagctgtccctccttctacccaaggtggagtcccccaaagtcccttctgtctggcctatcctgtgcccaccacctgtggcttcatccagccctcctcctctatctttatctgccataggccgcagccctggccccctgtggattgaggtcccaagtggtccagctgtggggtttggtgctgggaccctcaatggcagccggaaggtccctctgaggcagaagctcaagccccatggggacagtggctccccagtgcctggccctgagccatttctgctgtttcaggtgcccacatcaccctcatttcctcctcgcagtagccctgcaccgtggccagaaacccatccacaggcaggcagtggctggggtccgggtgccccgggctgttgggctctgcttcctccctctgctcccccatgtctccctgagttctcccacctttgctcatttgtaaaatgggcaggtcaatcttcccaccccaccgtgtgggctgccccaaccccaaatgtgcccagggaggggggggaacccaaggcacaggccccgcccctgcccccaagcagcactgggctactggctcacagaagcacctttggttctgcaggtcatgcccctccctgcagggaagggaaagctggtggtagaggctgggcacagactgacgtccagaagaagtcccttggccctgctagggtggcaccagacttctctggtcccacaggacagccagtggcctcccaacttggttctgggcccccgcctgcaagcacacatggcaaggagggctttagcaggctcacataaccgagtggcaaggcccctgctcccagaggctggatttgaatgaactccgggcctgtttggggaggtgaagctgccaggtgtgcacaggggcctcccaggctcctggctccaccagccaaggaggtgggggcaagggtcagggcaatgggggacaatgccgctcagggtgcagtgagctcccctgggaaaaccgaagccagcaagaccaggagagggccacctcactgggcctgcctcccccacctcctgggcctctctgacctcagctcctagaccctggacccttggctgggactcagcattttccagtctttttcaggggtagacaggggagcctgggttaaactttaccactgtgccctggcccaggcatcaccaacacggcctccctgcagctgccctgccaccgacagaccccgattaaacccacacctggccttggcctcccctgctctataccttgcatggtttttgcctcacttggaataaaattccaactcctccctgtggcgtaggaggttcttgggggctgacccatcacccctctggtggacagagacattgccagcgtggtggtcgtctgtgcttggttcagggcaaggctgggaggcagtgggtgctgaggtcttcagtgagcaaggagagaggcagggaggaggaggaggaggaggagagcacagcatgaaaggacgggaccctaaagggctttggcccaagggagggtggggcaagaatgttctgagacttctgtgggcagcaaagaggactgagcacctgttctccagcccccaggactgagagcctgcagagacaagctggcacagggcgaggggtggcagggaacttcagggtgggaggtgcatggggcaggcgggaggaggaagaacagagaggggacagagagggtatgaatgggagctcctggggtgcaggcttgctttccactatgaatgggtggaggagggaagagaagaaaattgcttttgagacccacccaggctgggtggcctcagggcctcccttgaatccctgctccacctcccacagccttgtggacttgggcaagtcactggccacctgagcctcagtttgcagtgacagtcaagacagctcaggccaggcgtagtggcttatgcctgtaatcccagcatgttgggaggccgaggcgggtggatcacttgaggccaggagtttgagaccagcctggccaacgtggtgaaaccccgtctctactaaaaatacaaaaattagcctggtgtggtggcacgcacctgtagtcccagctactcgagaggctaaggcaggagaatctcttgaacctgggagacagaggttgcagtgagccgaagtggcaccactgcacaccagcctgggctacagagcacgctctgtccaaataaacaaacaaacaaacactactcagtgtctcagaaaggacagaaggggactccctggctcaggcagaagctcagtgggtgtgcatttccttcaagactcgtccttcagaaggaataggcttctggggcagtacagaggagtctaagtgagaggcaggcctccctgggagctgggcccaggctctctgcagccatgcctttaaggagtgcctacggggtagcacgatcagatggacaggccagggctgcccagagctgggggtgggagcaaggtaagcagagaggtgagggaaggagggtgctggcttagcaggagctgaatgaatgggcctggaggggaaaagctaagggggatggggtggcttgagtggagtaggtgaggcctaggtgaaggggagctgtggaccttccaggacggacggatgtgagcagtcctgagtggggactggagttagggtggggaagggaagccccaggcagcccctgcaggcccctgcccctgggccctaccgcagcagggcagccctgtctctgggtctcagctgatgcttccctctgcccactggcccctgacctggtgggatttcccaccatctctcccggcccagcctgccctgccctcctaggtcttcccaacctcccctctgcagaaacatctcagccacgtctggcacccccaggcatccctgcctgcctctaggaagttgaccccttcaatgggtttcagcctccaaccccacccccgcttgactcctgctctgtcagcacttgcttgagaaaatcatcctgggaaaccagcttctgggagcaggggccttgccactcggttctgcgagcctgctgaagccctccttgccacgtgtgcttgcaggcgggggcccagaactaagctaggaggccactggctgtcctgtgggaccagggaagtctggtgccaccctagcagagggcccatggacttcttctggaggtcagtctgtgcccagcctctaccaccagtccagaacttgcagtgggtgcggtaaacggtggcccctcctcagcaaacatttccaggggattctggcagcagagtttccatgggaacatgtgctggttctgcgctgaacccggtgtggctggggttcccttcacagccaatattgcaggaactgagcctggtggcctcggccagggtaggcagtgctctttggccacccagtgtcacaaacctgaactcaagttacaggcaaaacctgcttttcctttttctttctctctctctctctttttttttttgttaaagcacattctaatgtaaagtccatgctccattctaaagatgcctctgggatttcagggatggatttttatgtagttcaatagttttcttggcagacagcttatgcaggagaggtgggccgttggctcagtccagccaggctgagtggcgtcactccattccttgcaatgccaggggatgtcatttgtccacctgagggggcttccccagtctcccttccctgacctgtggtcagaatgatggcctcagccttgactgagcgcgggtcaggccagactctctgaacttggtgttggcgtgtgttttgtgtgtgtctggaggtgacatatgtgggtgacagaagcatatgttacagtgaaacattaaaactacagcaaagtg

SEQ ID NO: 13817 - DNA, 671 bp, Homo sapiens
  ENST00000355469
cccagatggagaaccagcctgtgaggtggcgggccctgccaggcctcccacgccctcctgggctccccgcagccccctggctcctccttggcgtgctgctgctgcccgggaccctgcgactggcaggaggacagtcagtgacccacaccggcctgcccatcatggcctccctggccaacacagctatctccttcagctgcaggatcacctatccatacactccccaattcaaggttttcacagtcagctactttcatgaagatctccagggacagaggagccctaagaagccaacaaactgccaccctggactgggcacagagaaccagagccacaccctggactgccaggtcacccttgtgctgccgggagcatcggccactggcacctactactgctctgtccactggccacactccacggtgagaggcagcggcaccttcatcctggtcagagagacaagatttcgccatgttggccaggctggtctcgaatcctgacctcaagtgatccgcccacctcagcctccaagagtgttgggattacaggcatgagccagcacacccagccagttttcatcacattctcaaaggagtgatgatcccaaaagttatgagtgagcccatcaccaaagccctgattctctgacctacctctgcgatcccctggaa

SEQ ID NO: 13818 - DNA, 7525 bp, Homo sapiens
  ENST00000371564
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagcttggggggatggacgggggacagaagatgtgggcactgtgattaaaccccagcccttgcgttcgtttttccaggtcacagatacagctcctgtaccttttgaaggcaaggagttctcagagcaaccaaaggaacgtgacccaagagcccagcttacaggctgaagaaacccaaaaccctcgatagagacagaaactgaactgtcagtccttagagctcgcccagtccatgccacaactgggccacagctaaagctttatttttgaattctcattccaaaaccaaactgtcttgcccagacaagatcacctgttaagacttcttggcgttaagttatgacatgtatacgcgtttgttattattattttttctgctttaaaaggctgaccagggcacctagccctggagctgtcttggcgagctgttctttaacccctgcagcacgcagtcctgctaacacaatttccatagacttggggggctgacccaggctgcagagagcaagcacctgtctgctgcagctgtacaacctggatgctttgcaaggttccggcttgctttcttcctagcagccagagtgcttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgtatttttatgctttttacctgtcctcaaaatattacacccctgttggaattagatttatatttataaatggtcagaaatctttttaagtgtctctttttacacataggttgatttttttttcttaagagaaatgatgtattcttgaaacatttgttactcattccaggaaacaaaaacccatataataaaacccccactcagagcctgttagtcacctctctagaagatggcatctcaggagaaggaatggctttgtggaagaaggaatcacctttttcttgctcaagaattatgctgacttcagccctgagcctggatctggtcactgagaatcatcaagtgtctagatcctccccccaaaataactaatttagtaggtgattttgattttaaaaaattgacaccaaaaccctgcctgcattgtaatggaattcgaaaagaattcatgttcacagaactcaacgttcaggctaatatttacagaagggaccaaatctaaatcctggtagataactcctgtatgctttatccaaaggacacccacagttttccagcatagatataaccaaggatgaattgattccttcaaagaactgggaggcacggatattgcattttttgtttacatccagtagccaagacgcctcagtgagccagtcttgggcagaggctgtcacatttaggcagattggaagttggtatgttctaattctcactctggactacagtgaggctgaatttatcatgtcaaaaaaaaaaaaaaaaaaagacctttccaagtgctttctattgctcagaattgaaagaatgttttcatttcaagtttacaagaggcatggatggagttgtgacgttcttgacaagctgggctaacctttcccgaacttgtttcccggaggcaaggtgctcggtgacccagcgcatcttaaccttgggtctcctaggctcgaggctagggcattacgtttcgtggaaccaaagcagccaattgcatagcaagtattttcctgcattccaattaaatgcttaagaaaaagcagcatcctataaaattgtgatcataaacatccatttccctcagcttttgtgagtgccttgacttacagccaacatcactgtttaactcagtctgtttaaaaacaaacttttctggtggttgataacagagagttgctccctgagccatcagggtcctgggagctggaagtgaaagggttattaacattctacctttatgcagctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagcaacatcta

SEQ ID NO: 13819 - DNA, 7437 bp, Homo sapiens
  ENST00000396009
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagcttggggggatggacgggggacagaagatgtgggcactgtgattaaaccccagcccttgcgttcgtttttccaggtcacagatacagctcctgtaccttttgaaggcaaggagttctcagagcaaccaaaggaacgtgacccaagagcccagcttacaggctgaagaaacccaaaaccctcgatagagacagaaactgaactgtcagtccttagagctcgcccagtccatgccacaactgggccacagctaaagctttatttttgaattctcattccaaaaccaaactgtcttgcccagacaagatcacctgttaagacttcttggcgttaagttatgacatgtatacgcgtttgttattattattttttctgctttaaaaggctgaccagggcacctagccctggagctgtcttggcgagctgttctttaacccctgcagcacgcagtcctgctaacacaatttccatagacttggggggctgacccaggctgcagagagcaagcacctgtctgctgcagctgtacaacctggatgctttgcaaggttccggcttgctttcttcctagcagccagagtgcttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgtatttttatgctttttacctgtcctcaaaatattacacccctgttggaattagatttatatttataaatggtcagaaatctttttaagtgtctctttttacacataggttgatttttttttcttaagagaaatgatgtattcttgaaacatttgttactcattccaggaaacaaaaacccatataataaaacccccactcagagcctgttagtcacctctctagaagatggcatctcaggagaaggaatggctttgtggaagaaggaatcacctttttcttgctcaagaattatgctgacttcagccctgagcctggatctggtcactgagaatcatcaagtgtctagatcctccccccaaaataactaatttagtaggtgattttgattttaaaaaattgacaccaaaaccctgcctgcattgtaatggaattcgaaaagaattcatgttcacagaactcaacgttcaggctaatatttacagaagggaccaaatctaaatcctggtagataactcctgtatgctttatccaaaggacacccacagttttccagcatagatataaccaaggatgaattgattccttcaaagaactgggaggcacggatattgcattttttgtttacatccagtagccaagacgcctcagtgagccagtcttgggcagaggctgtcacatttaggcagattggaagttggtatgttctaattctcactctggactacagtgaggctgaatttatcatgtcaaaaaaaaaaaaaaaaaaagacctttccaagtgctttctattgctcagaattgaaagaatgttttcatttcaagtttacaagaggcatggatggagttgtgacgttcttgacaagctgggctaacctttcccgaacttgtttcccggaggcaaggtgctcggtgacccagcgcatcttaaccttgggtctcctaggctcgaggctagggcattacgtttcgtggaaccaaagcagccaattgcatagcaagtattttcctgcattccaattaaatgcttaagaaaaagcagcatcctataaaattgtgatcataaacatccatttccctcagcttttgtgagtgccttgacttacagccaacatcactgtttaactcagtctgtttaaaaacaaacttttctggtggttgataacagagagttgctccctgagccatcagggtcctgggagctggaagtgaaagggttattaacattctacctttatgcagctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagcaacatcta

SEQ ID NO: 13820 - DNA, 5690 bp, Homo sapiens
  ENST00000609943
tctggagtaagccggatcgcggagccgcgccgactccgccgagccgggagccgggaggcgcgcagctcccgggtcgctccgaggctcctcggccagggcagccccgcgggcacgcggtagagaagacggcgtcccctcggctgctggtcgatacaaacagatccccctttccaaacacgcgccaagtccccgtgccctccagatgcagagagaggctgcgttcagactggggcactgccatcccctccgcatcatggggtctgtggaccaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagcttggggggatggacgggggacagaagatgtgggcactgtgattaaaccccagcccttgcgttcgtttttccaggtcacagatacagctcctgtaccttttgaaggcaaggagttctcagagcaaccaaaggaacgtgacccaagagcccagcttacaggctgaagaaacccaaaaccctcgatagagacagaaactgaactgtcagtccttagagctcgcccagtccatgccacaactgggccacagctaaagctttatttttgaattctcattccaaaaccaaactgtcttgcccagacaagatcacctgttaagacttcttggcgttaagttatgacatgtatacgcgtttgttattattattttttctgctttaaaaggctgaccagggcacctagccctggagctgtcttggcgagctgttctttaacccctgcagcacgcagtcctgctaacacaatttccatagacttggggggctgacccaggctgcagagagcaagcacctgtctgctgcagctgtacaacctggatgctttgcaaggttccggcttgctttcttcctagcagccagagtgcttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgta

SEQ ID NO: 13821 - DNA, 2740 bp, Homo sapiens
  ENST00000610033
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctcta

SEQ ID NO: 13822 - DNA, 2974 bp, Homo sapiens
  ENST00000414705
atgcagagagaggctgcgttcagactggggcactgccatcccctccgcatcatggggtctgtggaccaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctcta

SEQ ID NO: 13823 - DNA, 2662 bp, Homo sapiens
  ENST00000609507
tctggagtaagccggatcgcggagccgcgccgactccgccgagccgggagccgggaggcgcgcagctcccgggtcgctccgaggctcctcggccagggcagccccgcgggcacgcggtagagaagacggcgtcccctcggctgctggtcgatacaaacagatccccctttccaaacacgcgccaagtccccgtgccctccagatgcagagagaggctgcgttcagactggggcactgccatcccctccgcatcatggggtctgtggaccaagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctcta

SEQ ID NO: 13824 - DNA, 620 bp, Homo sapiens
  ENST00000496054
gtgcagttttatgaatttccctgaccactgaggtgatatcactagtaagaaggaaactggggcccagtttagtatctgtagatgcctgaaggaagataacagttgagtagatctttaatgaaattctgattttcctttgactgcagcagaaaccagcttaattttctctttgtagttggccatgatttgaaaccccatcacatacccacagcagcccttttgtccaccctgaacacgctcccctgatcccacaccccacataatgtaatgcactttgcacagagtccctcatctccatgattattaccctagtgttgggttaattctggcacaaatgctaagatgttgcagaattctggcttaaactagagccaaagggttaagttccctcctgggcttggatgatatcggcatgagttggaagcgtaagagagatcaaaggtgatttttttttttcttctcaaaaatgattttgcaaatctttttcagagctgatagacacacaccttagctggatacaaaacatattatgaaacagaatgactgtgatctttgatccgagaaatcaaagttaaagttaatgaaattatcaggaaggagttttcaggacctcctgccag

SEQ ID NO: 13825 - DNA, 1495 bp, Homo sapiens
  ENST00000440487
gttgaatgatgcttgttaaagtgcagagcagaagccaccaaccaagcctcgccagtatctcccaccgagtcacgaatctcccatctaactccctctcacacaacccaggcctctccaagcctgactttcccggaaactccagtccaggtcttccttcctcctccagcccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcagtgtcttgctctgtcaccaagactggagtgcagtggtgtgatctcactcagcctcaacctcctgggctcaagcaatcctcctgcctcagcaggagtagct

SEQ ID NO: 13826 - DNA, 5700 bp, Homo sapiens
  ENST00000413692
gtaaacgtctgacctggggccgtcgcttaaccgtttagttgctgggatggggcggcgttgggggtgcggccctgaaccggagggatttagagactggagacgcggcctctaagagaggttgaaactgtgtgtgtgtgggagaaaatgataaccaccctcccatctctcctacccgccagcctcgccagtatctcccaccgagtcacgaatctcccatctaactccctctcacacaacccaggcctctccaagcctgactttcccggaaactccagtccaggtcttccttcctcctccagcccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 13827 - DNA, 2893 bp, Homo sapiens
  ENST00000554591
aaccgtttagttgctgggatggggcggcgttgggggtgcggccctgaaccggagggatttagagactggagacgcggcctctaagagaggttgaaactgtgtgtgtgtgggagaaaatgataaccaccctcccatctctcctacccgccagcctcgccagtatctcccaccgagtcacgaatctcccatctaactccctctcacacaacccaggcctctccaagcctgactttcccggaaactccagtccaggtcttccttcctcctccagcccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggg

SEQ ID NO: 13828 - DNA, 2131 bp, Homo sapiens
  ENST00000556957
gaagaggaggggaacccacagggtccggaggtttcaggcccctagtaaacctggcaaggatttttagaagagccggagtgggatgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctgtgagcaaagaggccctgggccatgtctctgtctcttgcaactcttttgtctgtgtgtgtgtgtctgtctgcccattccctctgcagcgtcctgtgccctgtctgtcctgggtagctctatagaggactcagcttctttctattctagtttgcccctgccacagactctgtctctggggtggcccagagtgacactggaccctatctattcctggggtgccctgtgcccttgtttgggaaactccctggtctaccctgtttaaccctctctctgctct

SEQ ID NO: 13829 - DNA, 2830 bp, Homo sapiens
  ENST00000555590
gaagaggaggggaacccacagggtccggaggtttcaggcccctagtaaacctggcaaggatttttagaagagccggagtgggatgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctga

SEQ ID NO: 13830 - DNA, 2506 bp, Homo sapiens
  ENST00000554966
gaagaggaggggaacccacagggtccggaggtttcaggcccctagtaaacctggcaaggatttttagaagagccggagtgggatgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 13831 - DNA, 5488 bp, Homo sapiens
  ENST00000424781
gaagaggaggggaacccacagggtccggaggtttcaggcccctagtaaacctggcaaggatttttagaagagccggagtgggatgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 13832 - DNA, 5686 bp, Homo sapiens
  ENST00000539237
ttccagactacagttctagggaggaggctgccaacttcccgtggaggctaattcacggcccctctgggtggctgggacaagggcagcggcaaagcctggcctggatctacgcccatcaagggctgtgggcctagggacagttctcaaagcctctttggctcggactgctcccagaggcatccaggctggctaagcgttcttcatctttgggggtcctggaggaatggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 13833 - DNA, 2924 bp, Homo sapiens
  ENST00000556279
atctacgcccatcaagggctgtgggcctagggacagttctcaaagcctctttggctcggactgctcccagaggcatccaggctggctaagcgttcttcatctttgggggtcctggaggaatggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctga

SEQ ID NO: 13834 - DNA, 2566 bp, Homo sapiens
  ENST00000553469
agttctcaaagcctctttggctcggactgctcccagaggcatccaggctggctaagcgttcttcatctttgggggtcctggaggaatggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 13835 - DNA, 3057 bp, Homo sapiens
  ENST00000554050
gaagagaggacagagggagggagggtgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtg

SEQ ID NO: 13836 - DNA, 3377 bp, Homo sapiens
  ENST00000554655
gggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggtctagggattgagatgggcttgagaatcctctgtatccaagtgaagcctttccaccccaacccctgcgctcagagctgggaagaagggagttttaggcttgttgtcatctttcacacctcaaggggctctgtcccctacttccccttgcttctggacttttggatttcttcatttctttgtcctttttttagtttaaaaaaaattcttttttcccttcttttcacaagtgttaatgtacttctttatttcttctgtgctttcctttctctcagacccataccccctcctccctcacagatccagtacgggcctgactggggtctgaggctgcacatgatcaatgctcttctctcccacccaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaact

SEQ ID NO: 13837 - DNA, 559 bp, Homo sapiens
  ENST00000554903
tttcccatctcatccctggaggaggggctggagcatccccggcagccaatcagggacaggctgggggggggaccgctttgaagaagtttgggggaaaaaagccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctccta

SEQ ID NO: 13838 - DNA, 573 bp, Homo sapiens
  ENST00000554779
ataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggacctctgccctacccccactggactggcctctgcccagccaatatgagcagctggagctgaggatcgaggtacagcctagagcccaccaccgggcccactatgagacagaaggcagccgtggagctgtcaaagctgcccctggcg

SEQ ID NO: 13839 - DNA, 1803 bp, Homo sapiens
  ENST00000557028
ataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctgtgagcaaagaggccctgggccatgtctctgtctcttgcaactcttttgtctgtgtgtgtgtgtctgtctgcccattccctctgcagcgtcctgtgccctgtctgtcctgggtagctctatagaggactcagcttctttctattctagtttgcccctgccacagactctgtctctggggtggcccagagtgacactggaccctatctattcctggggtgccctgtgcccttgtttgggaaactccctggtctaccctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctggtgagtacctgctggggaggggagggcaggcagggagagcttgggagtggcaggtgaaacatctctggcattgtcactaaactggccagtggagcctcagtttttttatttgtaaaatgggacagacagactaccctttctattatactgtctgctttccatgtgggatgggtatgacagcaatctaaaatgttgaggatgctgaacaaatggaagcaatgcacattctgtctaataaaga

SEQ ID NO: 13840 - DNA, 4749 bp, Homo sapiens
  ENST00000250373
gcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 13841 - DNA, 5367 bp, Homo sapiens
  ENST00000553708
atgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 13842 - DNA, 904 bp, Homo sapiens
  ENST00000557674
cctccgcccctagatggcgaggagagagggaggagccacctcccctcgtcaccacagccctgacgcccccctcccctctggccacggttgcgatggcaactggggctcctgccagcgccgtttgggggtttgggaaccgctgctaattgggttcatgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggc

SEQ ID NO: 13843 - DNA, 2707 bp, Homo sapiens
  ENST00000553879
acggttgcgatggcaactggggctcctgccagcgccgtttgggggtttgggaaccgctgctaattgggttcatgtaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctg

SEQ ID NO: 13844 - DNA, 2955 bp, Homo sapiens
  ENST00000554344
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaaggtctctttgctgaggggcagggagcatagaaggacttgcggcctggccactcaaggaacatagccatctcacctgcttctctctttccccctctccctctgctcctcttcccattttgacagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctga

SEQ ID NO: 13845 - DNA, 2631 bp, Homo sapiens
  ENST00000554661
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaaggtctctttgctgaggggcagggagcatagaaggacttgcggcctggccactcaaggaacatagccatctcacctgcttctctctttccccctctccctctgctcctcttcccattttgacagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 13846 - DNA, 2509 bp, Homo sapiens
  ENST00000556169
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 13847 - DNA, 5613 bp, Homo sapiens
  ENST00000557451
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaaggtctctttgctgaggggcagggagcatagaaggacttgcggcctggccactcaaggaacatagccatctcacctgcttctctctttccccctctccctctgctcctcttcccattttgacagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 13848 - DNA, 5491 bp, Homo sapiens
  ENST00000422617
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 13849 - DNA, 3169 bp, Homo sapiens
  ENST00000555453
cccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagt

SEQ ID NO: 13850 - DNA, 2420 bp, Homo sapiens
  ENST00000556302
accttaagacccactggatcgggtaccctcggtcctaggatccaggggccagtgggcaaaggcctggcatgcctgcttcaatctcctccatcttcccagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctgtgagcaaagaggccctgggccatgtctctgtctcttgcaactcttttgtctgtgtgtgtgtgtctgtctgcccattccctctgcagcgtcctgtgccctgtctgtcctgggtagctctatagaggactcagcttctttctattctagtttgcccctgccacagactctgtctctggggtggcccagagtgacactggaccctatctattcctggggtgccctgtgcccttgtttgggaaactccctggtctaccctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagca

SEQ ID NO: 13851 - DNA, 1382 bp, Homo sapiens
  ENST00000554473
gggacaccagcctcatgtctactctggaaaatggtggcccgccagatatgggggagggtttaggctgaggacaaaagtcactgggagttaagttttctctgtattgagttgggccagtctctttggaggctcttctgcctttgcccagcccactttgggctttattccaagaaaaacactgtgaactccaggccatgttttctccacaacgggtgcccagttccccaagggattcccttgcaggatatcctttatctttcaccattcccatcccatggtagactgaaaatctagggatgaataaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 13852 - DNA, 2025 bp, Homo sapiens
  ENST00000556759
gggacaccagcctcatgtctactctggaaaatggtggcccgccagatatgggggagggtttaggctgaggacaaaagtcactgggagttaagttttctctgtattgagttgggccagtctctttggaggctcttctgcctttgcccagcccactttgggctttattccaagaaaaacactgtgaactccaggccatgttttctccacaacgggtgcccagttccccaagggattcccttgcaggatatcctttatctttcaccattcccatcccatggtagactgaaaatctagggatgaataaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacag

SEQ ID NO: 13853 - DNA, 4364 bp, Homo sapiens
  ENST00000555167
gggacaccagcctcatgtctactctggaaaatggtggcccgccagatatgggggagggtttaggctgaggacaaaagtcactgggagttaagttttctctgtattgagttgggccagtctctttggaggctcttctgcctttgcccagcccactttgggctttattccaagaaaaacactgtgaactccaggccatgttttctccacaacgggtgcccagttccccaagggattcccttgcaggatatcctttatctttcaccattcccatcccatggtagactgaaaatctagggatgaataaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 13854 - DNA, 856 bp, Homo sapiens
  ENST00000557767
ctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 13855 - DNA, 2235 bp, Homo sapiens
  ENST00000555393
ctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctg

SEQ ID NO: 13856 - DNA, 1476 bp, Homo sapiens
  ENST00000555802
ctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctg

SEQ ID NO: 13857 - DNA, 447 bp, Homo sapiens
  ENST00000555821
cctacccagagtttcaggtttctgcctgtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtg

SEQ ID NO: 13858 - DNA, 2085 bp, Homo sapiens
  ENST00000297689
acgtagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacagaa

SEQ ID NO: 13859 - DNA, 1552 bp, Homo sapiens
  ENST00000590828
actctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccagatttggtggctcatgcctgtaatcctaacactctgggaggccgaggcgggcggatcacttgaggtgaggagtttgagaccagcctggccaacatggtgaaaccctgtctccactaaaaatacaaaaacaattggctggacatggtggcatgcgcctgtagtcccagctacttgggaggctgaggcagaagaattgattgaacccaggaggcggaggttgcagtgagccgagattgtgccactgcactccagcctaggtgacaaagagagactctgtctcaaaaaaaaaaaaaaaaaaaaa

SEQ ID NO: 13860 - DNA, 1834 bp, Homo sapiens
  ENST00000641389
ttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccaggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagct

SEQ ID NO: 13861 - DNA, 1736 bp, Homo sapiens
  ENST00000606253
aaaatttgctgattaaatgaatgtgggtgtgtttgagagggatcctagacagccaagccttctggcatgaaacgctgagaagatgggagtgtctgctggcagagatgaaagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccaggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagct

SEQ ID NO: 13862 - DNA, 1399 bp, Homo sapiens
  ENST00000586361
ggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggtatggccagctggcaggcaggggtttgtctggggggtagactggttgcccagattttggcttccagggccaggaggccaggggatacccttacccagcagtctgccttctcttcctcccaggctgtgcttaactctggggtccaggttgacctggaagccagagacttcgagggtaagttgggtgtgggcagggctggtgtggttggtgtggctgggcgaggtgggtgcagatgcgggtccctcactgtctccattctgcaggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccaggagatcaagagcaacaagacagttctgcacttggccgtgcaggct

SEQ ID NO: 13863 - DNA, 829 bp, Homo sapiens
  ENST00000588497
ttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggtatggccagctggcaggcaggggtttgtctggggggtagactggttgcccagattttggcttccagggccaggaggccaggggatacccttacccagcagtctgccttctcttcctcccaggctgtgcttaactctggggtccaggttgacctggaagccagagacttcgagggtaagttgggtgtgggcagggctggtgtggttggtgtggctgggcgaggtgggtgcagatgcgggtccctcactgtctccattctgcaggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagg

SEQ ID NO: 13864 - DNA, 751 bp, Homo sapiens
  ENST00000590094
gctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggtatggccagctggcaggcaggggtttgtctggggggtagactggttgcccagattttggcttccagggccaggaggccaggggatacccttacccagcagtctgccttctcttcctcccaggctgtgcttaactctggggtccaggttgacctggaagccagagacttcgagggtaagttgggtgtgggcagggctggtgtggttggtgtggctgggcgaggtgggtgcagatgcgggtccctcactgtctccattctgcaggcctcacc

SEQ ID NO: 13865 - DNA, 844 bp, Homo sapiens
  ENST00000591730
cgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggctggaccctggagagtttctgcacccccttcaggacccccacagttccccgctgtggtccctggaccatcgctggaggtggcccgagctcacatgctggctttggggccacagcagctgctggcccaggatgaggagggggacacgtgagtataagggatagggttgtctgcagactcttggcttggtgggggctgttctcacggctgtcccccacctgtcctcaggctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggtatggccagctggcaggcaggggtttgtctggggggtagactggttgcccagattttggcttccagggccaggaggccaggggatacccttacccagcagtctgccttctcttcctcc

SEQ ID NO: 13866 - DNA, 1036 bp, Homo sapiens
  ENST00000585925
tcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggaccccccagacacccagttctatgtaggatcttctctgccacaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttg

SEQ ID NO: 13867 - DNA, 622 bp, Homo sapiens
  ENST00000588039
ccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactgcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggtgagatacagagtgggtacaggatgctgaagggcccctaaaaattcgcagttgcactcctgcagtattctgagatgtctggagctcagttacgattcccttttccaggccgggcgtggtggctcacacctgtaatcccagcactttgggaggctgaggcag

SEQ ID NO: 13868 - DNA, 281 bp, Homo sapiens
  ENST00000585544
aacccttcctccgccggaacccaggctcggaaggtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacac

SEQ ID NO: 13869 - DNA, 1834 bp, Homo sapiens; identical to SEQ ID NO: 13860
  ENST00000396901

SEQ ID NO: 13870 - DNA, 8761 bp, Homo sapiens
  ENST00000380060
ggtggcgacggcgagcacagaaacgatggagttgagccagtcgaccctggttggaagcaagtgagaagagaccaggcgcacccctaaatttctgtgcggagcgcttgtcatcctccccagggaacggtgcacccaaaggaggactggctggactgatttgctagggagagggcggggaagaggaggcaaggtgagcagagaagccccctgcgtatccggactgccagatcgcgcttttgccggactcctgccccctccctgctcaggtgggcgcgcccggtctccagctcacaggggcgcttggaggagaccagaaagtcgccgcctggctgcgcgggatgcctttcgccaagcggatcgtggagccgcaatggctgtgcaggcagcggcgccctgcgcccggcccagcagtggacgcgagcggaggcagcgctgagccgccgccgcccttgcagccgccgggccggagggacctggacgaggtcgaggcgccagggccagaggagccagcccgcgccgtccctgcaccttcagggctgccaccgccgccgccgccactgcccgcgccggccgaccagactcagccgccgcacggagaggcgtccgtggctggcgaggagagcacggcggggatcccggaggcggcgcccgcagccggcgaggcgtcctcggcggcggcggcggcggccgtgctgctcatgctggacctatgcgcggtcagcaacgccgctctggcccgtgtcctccggcagctctcggacgtggcccggcacgcttgcagcctcttccaggagctcgagagcgacatccagctcacccaccgccgcgtctgggcgctgcagggcaagctcggcggcgtgcagcgcgtcctcagcacgcttgaccctaagcaggaggcagtgcccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtctttaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaattaaa

SEQ ID NO: 13871 - DNA, 8213 bp, Homo sapiens
  ENST00000398097
ctgatttgccattcaagtgaaccctggagggattagcagccagcctagcacttgggtgagaccatctccccctccaggggggagtcctagatgcagcacagaggttctgtgaaaatctgccatcctccttgcagaaggttgccctctctcgccctccatcccccccgccgtgcttgctgacttaagcagatcagctttcagctctctggcattcagagacgtctttgcataaaagaaaaggcccttccttaaggagcagagcgggaatccaagcatggctctggcctgctgcatgcccaagaatgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtttaacagcacccgttcgccctcccccactgaatgttgccacatgaccccgtggagtagaaagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtctttaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaa

SEQ ID NO: 13872 - DNA, 409 bp, Homo sapiens
  ENST00000485305
tcatagatttggcctaaccagtatacactgtgttgtgtgcacgtttttaattttttctttttttgcatttcatgttcatagtttaacagcacccgttcgccctcccccactgaatgttgccacatgaccccgtggagtagaaagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagac

SEQ ID NO: 13873 - DNA, 8860 bp, Homo sapiens
  ENST00000615422
ctggatctggatagtgtgtctggagggtaaagcagactgggccagttcatgccattcccgaggctgacaggctacccaggtgcttgtgaggtcctctttgcagccatttcttagtaaaaatcctcctggttcctaacatctgcttccagcagaatttctgtttaactcatggagagttccatcctaggatccctgtgtacatgaagaagatgagagtgagttaaatgctgtgtttgggggaaggaagccttccttccttgatctcttggatgagttgcaaaaactcatcttgcatctgcagtttccctcccttaatactcattacctctatgatggtttctttaatgcgtatgctcacccctgggtgaaaccaaggaagagcaatgctttgaaagatgacaggcaatggagccggtaggtgtagggcatgataaggataccttggggacgggaccacaagggacagaggcagggcaaggtataggccgaagttcaggtggacagcaggggcggcgtgcagaactacagctctgaggccctgcggccagaaggctggagctgaggcagcctttccattcatctctgaggctttcctccacatttttcagaaacaggacccccatctccacccccaagcaggctagccaggggcttgtcagtgttgatgagcgactgtgccaagggtgaggaatgaaggtacggagaggaaattagctagtcataggtagacggttggtgtcttggagcctcccgtgcctcggctcaggggcaaaagttgtccctatcagtatcataaatgccaaacctttctccggccttgagttagttcttaatgtgaatgcagtagtctggacttccactccacccagactttactcctgtcctcttccccaccccagggttggccaaaagcacaacttaaagccactgatggacaacgccctgtttcttgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtttaacagcacccgttcgccctcccccactgaatgttgccacatgaccccgtggagtagaaagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtctttaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaa

SEQ ID NO: 13874 - DNA, 8163 bp, Homo sapiens
  ENST00000617601
ctgatttgccattcaagtgaaccctggagggattagcagccagcctagcacttgggtgagaccatctccccctccaggggggagtcctagatgcagcacagaggttctgtgaaaatctgccatcctccttgcagaaggttgccctctctcgccctccatcccccccgccgtgcttgctgacttaagcagatcagctttcagctctctggcattcagagacgtctttgcataaaagaaaaggcccttccttaaggagcagagcgggaatccaagcatggctctggcctgctgcatgcccaagaatgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtctttaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaatt

SEQ ID NO: 13875 - DNA, 7500 bp, Homo sapiens
  ENST00000427025
gagcgcttcacagacgggaaggagagcaagtgggcggtttatgattctgccctgtgctggggcgagtgagctgagctctttgatttctcccaagtaaccgtgtgggtgaactgtaaactgggtgcctggcttgaccctgactctttttctctagggtgaggagttacttcaccagggcagctggctttctgccctggtggggaaagatgcccaggagaggagtaggattacaatttgggatgctagggacacgccaaagagtcggggtgccttggctttgtgttttgcaaagtcctgacaagtactcctgaaatgaacacgctgcttcattttttaaattatacttttatttgtttattattttttggccgtggatatcgcggatctagaaacggagtccacaatgtggctagggtaaaacatttttcttttctttcttaacccctccttttccctttctttttaattgggtgacacagaagccgtctttttggataatgcggtgcctgactgtcagcgttgtctaagagggaaacagcaggctcgtggagaggacctgggccaacgcaaaaaacccagcgttttgtttgctgggctgttctttgtctctagttgattttgaaaagaagatgaaaaaggaaggctcttcaggttccttcagactccagccgaatacaggttctctctcacgtgctgtaagttggataaatttctcctccttgtccaggcagacaaagaggctgtttcgcagtgatggagagctctcggtttgtgggcagcaggtggaagtggatgacgaaaactggatatacagagcccagcccagaaaagcggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactgcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatcagggcacagaaggggcaaggcattgctgcccagatgggccacttctcaggttcctctggcaacatgtctgtgctgagcgattctgcagggatcgtattcccttcccgccttgacagtgatgctggcttccatagtcttccgcgttctggagcaagggcaaacattcagtcccttgagccgaggctgggtgccctcggccctgcaggagacatgaatggcactttcctctaccagagaggtcacccacaagcagatgaaaacttaggccatttaggaggtgcctcagggactggaacacttttgagacccaaatcccaggagttgagacacttcgagagtgaaaatataatgagcccagcgtgtgtggtttctcctcatgcaacctactccaccagcatcatcccaaatgccacactgtcttcctcttccgaggtcatcgctattcccactgctcagagtgcgggacagcgggaaagtaaaagttctggctcatcacatgcaaggataaaatccagagaccacctcatctccaggcatgctgtgaaaggtgatcctcagtctcccggtcgccactggaatgagggccatgccaccattctttcacaggacttagaccctcattcccctggtgaacccgcactgttgtccctctgtgactcagccgtccctctaaatgctccagcaaatagggagaatgggtcccaagctatgccgtataattgtagaaacaacctggccttcccagcccacccccaagatgtggatggcaagagtgaatctagttattcagggggcggagggcacagcagctcggagccctgggaatacaaatcctcaggtaatggaagggcatcccccctgaagccgcatttagcaactcctggctattccactcccacaagtaacatgagcagctgcagtttggaccaaacgtccaacaaagaggatgctgggtcgctgtattctgaggaccacgatggctactgtgcatctgtgcacactgactctggacatggatctgggaatctgtgcaatagcagtgatggctttgggaaccccaggcacagcgtgatcaatgtttttgttggaagagctcagaaaaaccaaggggaccggtccaattaccaggataaatccctatcaagaaacatctctttgaagaaagcaaagaagcctcccctgccaccctcccggacagactccctccgcaggattcccaagaagagcagccagtgcaacgggcaggtgctcaacgagagcctgatcgccacactccagcactcgctgcagctgagcctcccaggcaagagtggcagctcgccctcccagagcccctgcagtgacttggaagagccctggctgccccgctcccggagccagagcacagttagtgctggcagcagcatgacttccgccaccacccccaatgtctactccctgtgcggggccacgccatcgcagagtgacacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaa

SEQ ID NO: 13876 - DNA, 6535 bp, Homo sapiens
  ENST00000343505
aggttcaaggactgttaatggtttgtaactgcctgacaataaactcaacctcagttacatcagcctgggcagatgtctaaggatatgagaccgggggaagaaaaagttagaatctgtagcagaaggacgaagcttgccacctgcctactgggctgagcttttaatgtgatttacatttctaagctctatgtaggtgccctggaaatggtggtcttcattaatgcaaagattaagtctttaattaaactttttaagaagaaaacggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactggggagaatttcgatcgccaggccagccttcggcggtctctaatttacacagacactctggtaagacgaccgaagaaagtcaaaaggagaaagactattacaggagtccctgacaacatacagaaggagctagcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatcagggcacagaaggggcaaggcattgctgcccagatgggccacttctcaggttcctctggcaacatgtctgtgctgagcgattctgcagggatcgtattcccttcccgccttgacagtgatgctggcttccatagtcttccgcgttctggagcaagggcaaacattcagtcccttgagccgaggctgggtgccctcggccctgcaggagacatgaatggcactttcctctaccagagaggtcacccacaagcagatgaaaacttaggccatttaggaggtgcctcagggactggaacacttttgagacccaaatcccaggagttgagacacttcgagagtgaaaatataatgagcccagcgtgtgtggtttctcctcatgcaacctactccaccagcatcatcccaaatgccacactgtcttcctcttccgaggtcatcgctattcccactgctcagagtgcgggacagcgggaaagtaaaagttctggctcatcacatgcaaggataaaatccagagaccacctcatctccaggcatgctgtgaaaggtgatcctcagtctcccggtcgccactggaatgagggccatgccaccattctttcacaggacttagaccctcattcccctggtgaacccgcactgttgtccctctgtgactcagccgtccctctaaatgctccagcaaatagggagaatgggtcccaagctatgccgtataattgtagaaacaacctggccttcccagcccacccccaagatgtggatggcaagagtgaatctagttattcagggggcggagggcacagcagctcggagccctgggaatacaaatcctcaggtaatggaagggcatcccccctgaagccgcatttagcaactcctggctattccactcccacaagtaacatgagcagctgcagtttggaccaaacgtccaacaaagaggatgctgggtcgctgtattctgaggaccacgatggctactgtgcatctgtgcacactgactctggacatggatctgggaatctgtgcaatagcagtgatggctttgggaaccccaggcacagcgtgatcaatgtttttgttggaagagctcagaaaaaccaaggggaccggtccaattaccaggataaatccctatcaagaaacatctctttgaagaaagcaaagaagcctcccctgccaccctcccggacagactccctccgcaggattcccaagaagagcagccagtgcaacgggcaggtgctcaacgagagcctgatcgccacactccagcactcgctgcagctgagcctcccaggcaagagtggcagctcgccctcccagagcccctgcagtgacttggaagagccctggctgccccgctcccggagccagagcacagttagtgctggcagcagcatgacttccgccaccacccccaatgtctactccctgtgcggggccacgccatcgcagagtgacacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcatt

SEQ ID NO: 13877 - DNA, 736 bp, Homo sapiens
  ENST00000342260
ggagacagctgtgcctagcactgcaggcttcatcagaccacagagcacagcccctccatggaactgctgcagaatgttctgtctgaaagcggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactgcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatc

SEQ ID NO: 13878 - DNA, 947 bp, Homo sapiens
  ENST00000426841
aggttcaaggactgttaatggtttgtaactgcctgacaataaactcaacctcagttacatcagcctgggcagatgtctaaggatatgagaccgggggaagaaaaagttagaatctgtagcagaaggacgaagcttgccacctgcctactgggctgagcttttaatgtgatttacatttctaagctctatgtaggtgccctggaaatggtggtcttcattaatgcaaagattaagtctttaattaaactttttaagaagaaaacggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactggtacgctttgctagccagacaggttcagaatgtacttgggagaatgactacagctttttgttttatgctgttagcatttcattgctacatcaaaggtgaatagctgtggtccaacttcatgctctttgtttaatgagaggaatattaaaactacatatgtgtgtgcatataaaatgtctactgcttgttgggttcgaagactatgtcgcca

SEQ ID NO: 13879 - DNA, 506 bp, Homo sapiens
  ENST00000491526
cggccgcgctgggccaccgcaccgccgcgctgcaccgccgcctcgacgccctgcaagccgccgctgcgcgcctggaccaccgccgagtgaaaatcccggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacacca

SEQ ID NO: 13880 - DNA, 568 bp, Homo sapiens
  ENST00000533765
agaatatagagttatcctgttgacgagcagttagaattgtattaacgaagaagaagagggaggttactgagcaaagaagtgaattttatcctattttaacatgggacatcgtgccggaacgagttctccatagatgctctgggatttattttgataatgaatgtaatatattgtctggagtctgtgaccgattcctctttcccgtggggtgcagttgcggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtg

SEQ ID NO: 13881 - DNA, 471 bp, Homo sapiens
  ENST00000479393
acgaagcttgccacctgcctactgggctgagcttttaatgtgatttacatttctaagctctatgtaggtgccctggaaatggtggtcttcattaatgcaaagattaagtctttaattaaactttttaagaagaaaacggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaaggtttgattgggcgtggtggctcacacctgtaatcccagcactttgggaggccac

SEQ ID NO: 13882 - DNA, 609 bp, Homo sapiens
  ENST00000534376
tttgatttctcccaagtaaccgtgtgggtgaactgtaaactgggtgcctggcttgaccctgactctttttctctaggaagccgtctttttggataatgcggtgcctgactgtcagcgttgtctaagagggaaacagcaggctcgtggagaggacctgggccaacgcaaaaaacccagcgttttgtttgctgggctgttctttgtctctagttgattttgaaaagaagatgaaaaaggaaggctcttcaggttccttcagactccagccgaatacaggttctctctcacgtgctgtaagttggataaatttctcctccttgtccaggcagacaaagaggctgtttcgcagtgatggagagctctcggtttgtgggcagcaggtggaagtggatgacgaaaactggatatacagagcccagcccagaaaaggtgactcgatttttaaaaaatttaaacatttgaaaaagtttgttatgtagaattctttgtttctatcactcccccttcatgatttttgcccccattaggagtttcttttgaaatgtttgtttttgtattggaattcggcgtcatttgtttacatgtctaaaataaaaatgctcttcctca

SEQ ID NO: 13883 - DNA, 459 bp, Homo sapiens
  ENST00000468095
cggccgcgctgggccaccgcaccgccgcgctgcaccgccgcctcgacgccctgcaagccgccgctgcgcgcctggaccaccgccgagtgaaaatccaagccgtctttttggataatgcggtgcctgactgtcagcgttgtctaagagggaaacagcaggctcgtggagaggacctgggccaacgcaaaaaacccagcgttttgtttgctgggctgttctttgtctctagttgattttgaaaagaagatgaaaaaggaaggctcttcaggttccttcagactccagccgaatacaggttctctctcacgtgctgtaagttggataaatttctcctccttgtccaggcagacaaagaggctgtttcgcagtgatggagagctctcggtttgtgggcagcaggtggaagtggatgacgaaaactggatatacagagcccagcccagaaaaggtgactcgatt

SEQ ID NO: 13884 - DNA, 3978 bp, Homo sapiens
  ENST00000373677
aaagaactccagattggacttcctggtgtaaatctcttcttgcttcacacaggtcatttccttggtagggtcgcagaaaaccttaagagctgcagggcttcaaagagaggaacttgcagtccaaagtagcaaaaggtgtctgcattctgagcctcttttcgtaactgagcactcaaggtggggatcattgagataagggcttggtccccaaaccaccacagcatgaatttattgactttctcttctcctcgatcctcatggtcctgggaagcaagcacttttccatttccaaatccagtggctcaaacacctggaaatagcctaaagaaaatgcaagtcaggcctggcagctagagcaggagtcctggctcatggcccttccccggcccagcgctcggccatggcaccctagagtgtgtgtctccactgtgctatttttcagaagaatatgaggaacagtactcggaggccagacttgtggggcagaccttccgctcttctgatgaggccactaagcccacccccaacccaaggccccagtctgccaggcgtctggagtttatattgatggtgagttgcctcatcccccacctgggagagccagcatgcacccactgacaagagacctccagctgcttactttacccactggaagctgctcagccctgctcaccagcagagctaccctgaggccccactgggataggccctgcacagcaggtgcctggcctggtggcctgtccacgctttcctgcctcccagacgaagcctccaactacccagcctaaacagccaccctatgggcactggctcattgccaggcaggaatacaccctttccatcaccttctctcccaacagcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctgggttagtaaactgtctgctggctttttccttcagtcacaggagagatgagggtgagaatggagtgccagagatggaagcagatgccccagaataattatcctgatcccaagtcagtagcgggcaccctttgagggtttgagttactctaaataggaaccacgggctggccttactgcccttgagatcaagactagcccgaggcagatctccaaggcccagtttaggccactctcccctctaaatctctagtgctgagataatgaaatcaaactaggttctagcaccctaggacttcagcatcccacatccctagccaagcatgcatcctgtcttgggaactactccacctcactgtacagtacttttcattggctgcagtgaatttagttccctacatgggacccagtaccccaccagactgagttcaagtgccatggcaggctcggagccatctgaaacaacggaatatgttgccaccagcagcctctttttgtgccttccggaggaaagggagctcactttcttgggtggtttgagttctttggctcttcctggaaccataaacataatacataatgcttctcatccttt

SEQ ID NO: 13885 - DNA, 2269 bp, Homo sapiens
  ENST00000623354
cttaatgcctttttcagtttgattgtctacatggagatcagggtgataagtttcaataaacatatagacgcccccccacccacccccattagctagaaaagaccaggactgggttgctttaaatgaaccaagcttgaccaacaaacaagacagccatttgttcactcagatctagccgaggtaactcacaagtgcaccttgagatcctccatgtgtctgtcaacagcgataggcaggatctgcgcccagctcatgctgcattctaagaactctcatttcatttgcatataaaattcattacaggaagtaattaactgaaggaacagcatcatcaaaggctcaaggataatggaaaccgtcatcatgattatctactgggacctcatcagccacagtgagatgttctctgacagttacatgagccaggaaattgcagacgggctgcgcctggaggtggaagggaagatagtcagtaggacagaaggtaacatttttgactcgctcattggtggaaatgcctccgctgaaggccctgagggcaaaggtaccgaaagcacagtaatcactggtgtcgatagtgtcatgaatcatcacctgcaagaaacaagcttcacaaaagaagcctacaataagtgcatcaaagattacatgaaatcaatcaaaggcaaactggaagaacagagaccaaaaagagtaaaaccttttatgacaggagctgcagaacagatcaagcacatccttgctaatttcaaaaactaccagaaaacatgaatccagatggcatggttgctctgcggactactgtgaggatggtgtgacccgatatatgattttctttaaggatggtttagaaatggaaaaatgttaacaaatttggcaattactttggatctatcacctgtcatcataactggcttctgtttgtcatccacataacaccaggacttaagacaaatgggactgatatcatcttgagttcttcattattttgactgatttatttggagtggaggcattgttttttagaaaaacatgtcatgtaggttgtctaaaagtaaaatgcatttaaacttaaaaaaaaatacctgagactgggtaatttagaaaaacaatagatttctttatcttgtggttctataggctgagaagttcaagggcatggccctggtttctggcaagggcttttgtgctgtgtcacaacatagtggagaagatcaaagagaaagtggacacatgcaaagaggggaaaacctgagtggcatcccggctttataacaacccactgtcacaggaactaatccattcctgagagaactaatccagtcttgtgagactgagaattcactcactcctgcaagactgccaccaagccattcacgaaggatccatccccatgacccagacacctcccactaggacccaccttccaacatttggggatcaaatttcaacatgagttttgatggagacaaataaaccacatccaaaccatagcacagggactgctaaataccccaacaacagaaatagaaagctcccctaaacaccttctttaactgagacctggctgtctcctgagaaccccacttcgcctgtaggcctctcctcagagattctttccctcccgcaaatacttctgcatctggaggtggagtgggccccttctttgctccccactgcaccttccagaccatgaccactgtacctctcaggcacttccctccattctatccttttgcccaccccctagtcttgcccaaatccaaatcacttcaacattcatgtgaaagatctatcccacttcccacacttcttgtttcttcggcctactcacctctgttgccctccctttctgctccagtcacccactctcagggccccaagtggatcttgcgatggcccagaactgctgcaccattgaaatcttaacttcaatccccacaacctcacatctttctaactttcccatctgattacttcattacactgttcagctttgttgagacttgtatgagctcatcacaaaagaagaaatcccaatgtccaataaacatggaaatgtgcttaacctcatctactgtcagggaaacgaagaatgagggagaatggggcatgaggaaggagcatgagaaaactttttgaggtaatagatatgtgcattatcttgattgtggctctggtttcaaggatgtttactaatcaaatcgtcacttaaaacgtgcagtttgttgtacatcaattatatatcaataaagttgtaaaatataca

SEQ ID NO: 13886 - DNA, 3082 bp, Homo sapiens
  ENST00000510661
gatgaggccactaagcccacccccaacccaaggccccagtctgccaggcgtctggagtttatattgatgcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctgggttagtaaactgtctgctggctttttccttcagtcacaggagagatgagggtgagaatggagtgccagagatggaagcagatgccccagaataattatcctgatcccaagtcagtagcgggcaccctttgagggtttgagttactctaaataggaaccacgggctggccttactgcccttgagatcaagactagcccgaggcagatctccaaggcccagtttaggccactctcccctctaaatctctagtgctgagataatgaaatcaaactaggttctagcaccctaggacttcagcatcccacatccctagccaagcatgcatcctgtcttgggaactactccacctcactgtacagtacttttcattggctgcagtgaatttagttccctacatgggacccagtaccccaccagactgagttcaagtgccatggcaggctcggagccatctgaaacaacggaatatgttgccaccagcagcct

SEQ ID NO: 13887 - DNA, 3402 bp, Homo sapiens
  ENST00000639939
ctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaagaagaatatgaggaacagtactcggaggccagacttgtggggcagaccttccgctcttctgatgaggccactaagcccacccccaacccaaggccccagtctgccaggcgtctggagtttatattgatgcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctgggcagcagtttgataaacatgcaagtttgcgacactcgttgtttaacacagagacagccgtgaaccccaagtccaccctgaggcggaggcggaccattattggattctctaacttttcccagcgagaccaaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctggggagttctgtggaaccaggcaccgaagaaaaaagtttaatcagtgataaaacagctgaatggattgcagaggatgatgatgacgtgtttgtggcttcacgcacaactgaagatttatttactgtgatacacaggtccaaaaggaagctgctcggctggaaggaacctggtgaggcctttgtgggtggcagaacgagttcccactcaccaataaagaacacagctgagtctccaatcagtgagtctaccgccactgcagggtcaggcagcagtgccaacctagatgctggcagaaatgacgatttcaaggccttgctacagaagaagggaagtaaggcaactccaaggtctcgtccctcagcagctgaacttctgaagaccactaacccactggctcggagaattattgcacaattttcaaaagactatgaaaccaccgataaccccagtacctaa

SEQ ID NO: 13888 - DNA, 2955 bp, Homo sapiens
  ENST00000632230
ttcccctcactgcaggacagccgctgagcgggaggtcagccctctgaggggctctgactcgggcctttggctgagaaccttacctagagaaagacaagcccaactcacagtaaacttccctcgcctgtccgctgtgactgggccgacgggtccagggtggctgtgggtggagtgcagcggggtggagaaagagagaggaaactcacttttgaatcctcagttgctttccctaggctgggctgcccaggaacaacttcaatgggcaaaggagtatgtgatcgatgggaccaaggtgctgggaaacggggttcaggaaagtccctgggcacccactgaggagcctagggacagggtttgggacagtgtggagcccgtcggctccctgcccccagtgtgggctcagcacacacttttctcatgtggattcttggttatccacaccgctgggatggagagaactgactctgtcaccctcttctggatccggggaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctggggagttctgtggaaccaggcaccgaagaaaaaagtttaatcagtgataaaacagctgaatggattgcagaggatgatgatgacgtgtttgtggcttcacgcacaactgaagatttatttactgtgatacacag

SEQ ID NO: 13889 - DNA, 12593 bp, Homo sapiens
  ENST00000631375
gccgcggtggctgccagtccagagcagaatgatgggcaactctcaccacaagcaaccgaggagtaaaagccaaagcaggatgcattcagcaacaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctggggagttctgtggaaccaggcaccgaagaaaaaagtttaatcagtgataaaacagctgaatggattgcagaggatgatgatgacgtgtttgtggcttcacgcacaactgaagatttatttactgtgatacacaggtccaaaaggaagctgctcggctggaaggaacctggtgaggcctttgtgggtggcagaacgagttcccactcaccaataaagaacacagctgagtctccaatcagtgagtctaccgccactgcagggtcaggcagcagtgccaacctagatgctggcagaaatgacgatttcaaggccttgctacagaagaagggaagtaaggcaactccaaggtctcgtccctcagcagctgaacttctgaagaccactaacccactggctcggagaattattgcacaattttcaaaagactatgaaaccaccgataaccccagtacctaagccctgggctcaacaagcagggtttacttactaaacttgagtagagaagggggaagagaaagggtctttaaacagaaccatgggaacaacagagcctacatttcttttatattaactcacactctggacagcaggagagaggctacttcatctagagctaaaatcatctggcacttaatcatcttcagacatttttatgttttcatacttataagcttgtcatgactgactaccgagtttcttcttattttcccccagtggtgtgcactaactaagaagaaattttcagatgtcagggcacatgtgccactttttcaattcagtgacccggctgctccatccctggctcctgtcactgaggagtgcagtgtgagagcagattggaggctgccaaacttggggggcatagggtgccattgcttattattcactttcctagggaggctctgatggccctgtgtgcaaacacagaaagactctgatgcctcctcaaccacagtttagctttcccctgcgctcacaagaggtttgcagggtgcacttatttcggcatgaggttgattggatggcttttgtggtgcaaaatatgactgtgactctgtcctgaaacttaatgcctttttcagtttgattgtctacatggagatcagggtgataagtttcaataaacatatagacgcccccccacccacccccattagctagaaaagaccaggactgggttgctttaaatgaaccaagcttgaccaacaaacaagacagccatttgttcactcagatctagccgaggtaactcacaagtgcaccttgagatcctccatgtgtctgtcaacagcgataggcaggatctgcgcccagctcatgctgcattctaagaactctcatttcatttgcatataaaattcattacaggaagtaattaactgaaggaacagcatcatcaaaggctcaaggataatggaaagtaagtgcatcttgccccccaccagtcaattcagatcgtggtttgtggttggtttggttttgtttaaaggaagtccgactctgttccaaaaaccaagaacatataaactaaaaggatctatccaaaatctaaaaggcagtcttgccagttgctatggcccataatgcacacacacacacacacacacacacacacacacacacacacaaaagggctactttttgccatttaggttctgtgtttgaccagctttcaattaaccttgctgggggagagcataagaacctgggtaaatggcatactgaaagagcttcagaataatcattgcgacccctccctgcccccaccccccacgaagcttataggcactaactattcttgtcagctcaattttctaagcagagcaagagcagtgattcatttgatttttgtatgcctgatttctgggaggttggggaggaagacaaagcactgagcaaagaaaacctgctgaccaatgatggaaagttaattgtctactgtcttcaagaggcaaaaagaacagttgaatgaaattgtagcctgcttcacaaagagagttccccagccccttcctacttcacccctcacccaatagattcaatggtcaacctcctggaggatgcagtaaggttccagagacaagcagatctcaactttgataggtcgtattgcccaatgagaagccaccttttagctcaactgcccacactccagctggacagagcagctgaaaaaccacactaagtactgagaaaacttgggcctctcacaagagaagccctaggcctaggccctttgttgttatagttctgaatctgagacttctggaaacaggccaggcccaccaactcccttgcaaccagcacttcgacacttaaaataataaaacagctaggctcagttgcttttgaaagtactagaactacttggtgtgaagttcttaaccaaattccaaattccagggattttgcccaaaataaaatcaattcatccctggcctcagtttatatatgaatgccacatttgtctgctccagacttagaattccaaaaaacagacattttcctctgtagtaaatgaaggagcgtttgtgcttttgcttagcaaaaatgaaaggacaccagggtctccttgggaaccattatgactggttgaacgttaaagctgagtatgggactcacatagtataggccttgttacttctgtggacttttctggaagtttcttgtttactacttctaatgggttttgcctctcccctcaccttgctacctctggaggttttcccaaaagattctgaacctgaattctcagacaccttgatgtttgtcagttacctttagtcttgttttcctctacaatactctatatgcctggaatttttagaatatcttctacatcatcactgtggcccacgcagtggtgttcccattagcacaagaggatttggggcagaaatcatatggtcagagagaacatttaagaccggaagtattcatttaattttttaaattaattttttgtaaagatgggggttttgctatgttgcccacgctggtcttgaactcctgagctcaagcgatcctctcgccttggcctcccaaagtgctgggattaaaggagtaagccactgcacctggcctcatttaatattttgcaacaggtagacgtcccaaataaacaaccaaactgtaaaatttctactaatcactaattaacagaacacaaagcatcttccccactcctaacactcaacctctctcctacctttgattatcataactccactctctctcccacccaggcacttaccacaatgtttgctgccttctgcacctacgctgctgagactggagaagagaggctgaaagcccctctcagaaaggcttgcagagaacccaccactactacaattactagtataaataataatgataataatttttgaaggtggaatagagaagagatttgagtgaaatgaagttggccctaggagctcagcttccatttcaagtcgtccctatcctcttttttcctccccattccagttagtagcaacagatggctctgctagcctgactttgatctagtcaccatccccaggagcggaggttaattgttaaccaaggatgctttgcatttggtgggtagtcagtacatgtttttgagggtagttattcttggtacaatagcaagctttgctggtgtctcctctccttatcctgtactacttggcctgcctcagctcctgactgggcctcccccaccagccccaacttattcctcagccccaacttatccctcagccccaaatcccatgaactgcatccctagcacaacaactcacccataaaggaagtgagacaacaggaagcaaaataattaatgttagcttaatgaccacaaactgaccagttgatctggataaattaccttgaacgtgcaaagacagaggagatcctaccaggctctcctaacaagcactgcacctgacatccagtgtaactatctggacaacacagacccgattgcagtctctctgtacctgtcagtctgagcagatctgtccacgcacctgccctcttcctcatcaatgaacaagttgggaaaaagatgagttcatgctcagtgctctgttcctcactcgttccaccttccattatcaagtctgtgacacaatggtgagctttcgctttaatatgatttgctagggccaggactagggtgaggtgagcgaggcacctagggcgtaaaattcaaagaggtgcccgctctcagggccatgcaagtgccttaccctcgtcccagccctgtgatttgcactctttaaagtaatatcagtttatcttcttcctatgaacaagtatagtccttctgatttggggtcgggggttaactccctatctcttgttgcaccaaatattttattgctacctatttttccattgctataagtctttgtgtgcctatacattaaagaatctttaatagtgttaatatcggaaaacatagttgatttctaagtaatatgctccaggtggcaagttaacacccatttcagcagggatgctcccaaggccagcccttcaacaaaagagtgactgagttgacggtctgtcaccaggatcctccctctcctctttctgctccattctcctaaaccttgcttcccagcaccaactctcttcagtgcctcctacttccttctcctcctaagaaaaacctgctctcaggaaagggataaattcatttactttgagattataaggcttaatgctacctcttttgagggtcagttgcattttaacaagggaaaagccttaagccaatggaatgaagttctacttgcagaatgttaggcatcaactagttgtagaagtgtatttttcaccatggaaaggccaaattccctgacgcctaactccagaatatagaaaatatcttaatcgcctggaatcatttgagttactagctgatggtcaattaaattgtcctgatatccaatgctattcaatatggttactaccaagggactctcagaaatggctactaaaagccactgagaaggcctagatcattcatattgtacattgacatttttacataaatggaattaatactacttaccatttgagtaaagaacacaaggaattgaagagtctgtgaaaatatgtcctgtttgtgaaaggtgaaactgtccaatccatgtccaatcaatgtcagtcgtccagtattggtggtgattattaaacttattggaggtacaactttacctccaataagcttacctttacaagcttctgctttccctgcttcatctctgttatgggctatcagtccagcttggtgtgaaaatgagactatatctataccacagcccccaatcctttcaaaggctttgcatgtatttcagctacaagtgacaaggatattagggatttaaaaggataagagagtgggaaagatgtataaggaagtgcctttgtcaaaaggcagcaaaaagtataatgatataaacataatatgaaataagcaaattttagaatactttgaaacagatttatagaggaatacatagtaaatagttatagacacacatttggggcatttttaataaggttagcaagaagaaatttgcatgagtaatgagcaatgtgaaatgggcattatacttttgttcagtaaagcccaaaatctaggccaatggttctcaaagtgcagttccaggagcagcaacagcagcatccctggagagggagaaagagagagagagagagtgtatgtgtgtgtgtgtgtgtgtgtgtgtgtgtgtgtgtgtgtatgtgcattccagtgatgttactccttcaagcccctgaatcactatagccacgactctccaactgattccaacctttaccattattctggctctcatcataaggaccagtctctggccaagaggtgtatattgttatcttggtcaggcatatgtttgcttggttttaagaaattatcagattgaggagtctcatgttttatgggactccggtgcatatgctcgaaaaaaattaaaaagaacttatcatattggatcaacaaattgctcaacctgcaaaatctttgattagacttagccagcccatctggcctgctttgggtttaaaaaaaaaaaaaagattttttttaactcacaaatggaaaaaagggaaaggtgttaagtttgtttggtattgccagctcttaaatacctgtctttaccgtggtggctgttctccagtaaggctctggcagaagtatatttgattttaagatttttgcctaaatagtagaatttgatagcaacgaactccaaaacaaaatctgaactggaacaactagttaacccctctcagcctctttgtaatgccaagctttatagacatttattccttaggtggtcttgagctttttctaacatccaattttataaaatgttgtgcatgcaaacgcagcattgtgctcattgtacaagtcacctcaaactcattccttcccccatgtgtatcatggcgaagaaatatcaatatatgtatgtgctgaggtcttctgatgaattgtaaattacaaaccttttcattcatttttaaatgagatatatttaccctggctagtggttaaagttttattctttttattatatttcactgctacttttttctactgactccaaagcttactttgggctatatttcttatttctagattgttgtatttatcttatttctatatttatctgcagtcttggaatgttagagctgaaagggaccaacctctctcatttcacacatgaggaagctgaggcccagaaaggtcaaataacttatatacaaggtcacacagtgagtcagtggtggggcccagcctcaattccaggtctcctgcccttgggcccaatctggtttcatttaaagcactacaatttatagaagacccacagctggcttctacttttatgacacatgaatttcccaggtatttcaatgaactaatatatatgctttaagggaaaatgttcaagagttctttaattcattaatccaaagacaaattggattttcagtttataaacattagtttccctccaaattcaatatgtgcaccctacttagtacaatggatgttttccctaaaagttgtgtgaaaaatgagttttttagatatcaagtatcattttttagaggtaaacttcctatgtaagggaaccttctggtgacttctttttgaaaaaccgagattcctcttgtcattgtcccataatgtctctactttttttagtgcaaacttttgtatttggtgtttatttaaaagtagggtacaacccaaccaatattagctttcccagagtctactttagccttcccttcttaatctttatgagaaattttcagactgttaaatgctcatgagatatttagttgtgttctagaaatttcacctggcttgatattctgtcaatccctgggctcaaattccagctccatcttatcaaacaataacagaattccctaatcagtactaagctccgcatgcagtctcttttccagaacattctttgcctaatgttccttagtgtggctctctctttagttggggcctccttccttagtacatgcataccttactattctgtggaattgcaagccatgcatcttttagagccacactagtcaaattgattggcatttccatttattttccattgttcccttgtttctcctggacttcctctcgtttctcttttcgaggatgcttagaggcttctcaccagagattggtgaggtttcccccatcatctagatgggagattgacaaattctgtaaaggttaagacagtaactattttaggctttgtgggctacatgtggtctctgtagcacattcttctttgttgttgctgtttgttcattcgtttgttttgcaacctttggataatgtaaaccactctctttttttttgacagagtctctctctgtagccaggctggagggcaattgtacaatctcggctcattacaacctccacctcccgggttcaggcaattctcctgcctcagcttcccgagtagctgggactataggtgcgtgccaccatgcccagctaatattttttttttttttgtatttttagtagaggcagagtttcaccatgttggccaggatgttctcgatctcctgaccttgtgatccgcccacctcggcctcccaaagtgctgggattacaggtgtgagctaccgcaccctgccaatataaactattcttagctcatgggctatgcaaagccttaggctgacccctgatccagactgtcttctgagacaagcatttctgtgagctgccccatgtgataactgagttgtgcagtagctgatgtggtttattgccttcccatctactgcattgtcagaccagactgactgcacaggagcaggtggaggggggctgcatatgccaaccattactcttcaatagagtgtccttcatgagctctctctctctctcattactgactacctcagtgtagaaaccctcatttttttccccagacctatccttgttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgttggaaagtctggcagcccaggccataggattccagttcagcctacgatttcctagggaaatcaccaggttccaaaggctggtttttaaacctagaatatccatgtatccatttcctaatgcagtttggacctgttctagacagagcactcagccttagcaagaaaaccaatgaggtgcagaagatattctgtgcccacagtttttccctgccttctggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcgtataaacgttgtgggataagaatggatgatatgtatgtgtctgtgtgagtttggtttctcaacctggactgtgagggctaattcacaaatcacaccatacatgcgtgtgtgcatgcgcgcgcgcacacacacacacacacacacacacacacacacagtccagcaccctcatcagttctctggtttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgcagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaaggcattccttactggcttgctaccagcaattgaactgtattctttatatagctagagctgtttgtgtcttcttaaaataaactttttctgttaaaatca

SEQ ID NO: 13890 - DNA, 452 bp, Homo sapiens
  ENST00000631833
aggaagaaaaaagaaggggttagctttggtcctgcctcctttcctttctctcatttgctcgtctctcctccgtccttcgtctggaaatttggtgaacttggccaggaggttccagagcccagggctttccccagcagcctcgtcctctcacctggtccctccttcagctcctgagcacacagtttggaggacagctggacaagtggctggaatgagtagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaagaagaatatgaggaacagtactcggaggccagacttgtggggcagaccttccgctcttctgatgaggccactaagccc

SEQ ID NO: 13891 - DNA, 13660 bp, Homo sapiens
  ENST00000633930
ggaggaggagcccggcgaagcagagtcagagggactggtggctccggcgagtgtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaagaagaatatgaggaacagtactcggaggccagacttgtggggcagaccttccgctcttctgatgaggccactaagcccacccccaacccaaggccccagtctgccaggcgtctggagtttatattgatgcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctgggcagcagtttgataaacatgcaagtttgcgacactcgttgtttaacacagagacagccgtgaaccccaagtccaccctgaggcggaggcggaccattattggattctctaacttttcccagcgagaccaaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctggggagttctgtggaaccaggcaccgaagaaaaaagtttaatcagtgataaaacagctgaatggattgcagaggatgatgatgacgtgtttgtggcttcacgcacaactgaagatttatttactgtgatacacaggtccaaaaggaagctgctcggctggaaggaacctggtgaggcctttgtgggtggcagaacgagttcccactcaccaataaagaacacagctgagtctccaatcagtgagtctaccgccactgcagggtcaggcagcagtgccaacctagatgctggcagaaatgacgatttcaaggccttgctacagaagaagggaagtaaggcaactccaaggtctcgtccctcagcagctgaacttctgaagaccactaacccactggctcggagaattattgcacaattttcaaaagactatgaaaccaccgataaccccagtacctaagccctgggctcaacaagcagggtttacttactaaacttgagtagagaagggggaagagaaagggtctttaaacagaaccatgggaacaacagagcctacatttcttttatattaactcacactctggacagcaggagagaggctacttcatctagagctaaaatcatctggcacttaatcatcttcagacatttttatgttttcatacttataagcttgtcatgactgactaccgagtttcttcttattttcccccagtggtgtgcactaactaagaagaaattttcagatgtcagggcacatgtgccactttttcaattcagtgacccggctgctccatccctggctcctgtcactgaggagtgcagtgtgagagcagattggaggctgccaaacttggggggcatagggtgccattgcttattattcactttcctagggaggctctgatggccctgtgtgcaaacacagaaagactctgatgcctcctcaaccacagtttagctttcccctgcgctcacaagaggtttgcagggtgcacttatttcggcatgaggttgattggatggcttttgtggtgcaaaatatgactgtgactctgtcctgaaacttaatgcctttttcagtttgattgtctacatggagatcagggtgataagtttcaataaacatatagacgcccccccacccacccccattagctagaaaagaccaggactgggttgctttaaatgaaccaagcttgaccaacaaacaagacagccatttgttcactcagatctagccgaggtaactcacaagtgcaccttgagatcctccatgtgtctgtcaacagcgataggcaggatctgcgcccagctcatgctgcattctaagaactctcatttcatttgcatataaaattcattacaggaagtaattaactgaaggaacagcatcatcaaaggctcaaggataatggaaagtaagtgcatcttgccccccaccagtcaattcagatcgtggtttgtggttggtttggttttgtttaaaggaagtccgactctgttccaaaaaccaagaacatataaactaaaaggatctatccaaaatctaaaaggcagtcttgccagttgctatggcccataatgcacacacacacacacacacacacacacacacacacacacacaaaagggctactttttgccatttaggttctgtgtttgaccagctttcaattaaccttgctgggggagagcataagaacctgggtaaatggcatactgaaagagcttcagaataatcattgcgacccctccctgcccccaccccccacgaagcttataggcactaactattcttgtcagctcaattttctaagcagagcaagagcagtgattcatttgatttttgtatgcctgatttctgggaggttggggaggaagacaaagcactgagcaaagaaaacctgctgaccaatgatggaaagttaattgtctactgtcttcaagaggcaaaaagaacagttgaatgaaattgtagcctgcttcacaaagagagttccccagccccttcctacttcacccctcacccaatagattcaatggtcaacctcctggaggatgcagtaaggttccagagacaagcagatctcaactttgataggtcgtattgcccaatgagaagccaccttttagctcaactgcccacactccagctggacagagcagctgaaaaaccacactaagtactgagaaaacttgggcctctcacaagagaagccctaggcctaggccctttgttgttatagttctgaatctgagacttctggaaacaggccaggcccaccaactcccttgcaaccagcacttcgacacttaaaataataaaacagctaggctcagttgcttttgaaagtactagaactacttggtgtgaagttcttaaccaaattccaaattccagggattttgcccaaaataaaatcaattcatccctggcctcagtttatatatgaatgccacatttgtctgctccagacttagaattccaaaaaacagacattttcctctgtagtaaatgaaggagcgtttgtgcttttgcttagcaaaaatgaaaggacaccagggtctccttgggaaccattatgactggttgaacgttaaagctgagtatgggactcacatagtataggccttgttacttctgtggacttttctggaagtttcttgtttactacttctaatgggttttgcctctcccctcaccttgctacctctggaggttttcccaaaagattctgaacctgaattctcagacaccttgatgtttgtcagttacctttagtcttgttttcctctacaatactctatatgcctggaatttttagaatatcttctacatcatcactgtggcccacgcagtggtgttcccattagcacaagaggatttggggcagaaatcatatggtcagagagaacatttaagaccggaagtattcatttaattttttaaattaattttttgtaaagatgggggttttgctatgttgcccacgctggtcttgaactcctgagctcaagcgatcctctcgccttggcctcccaaagtgctgggattaaaggagtaagccactgcacctggcctcatttaatattttgcaacaggtagacgtcccaaataaacaaccaaactgtaaaatttctactaatcactaattaacagaacacaaagcatcttccccactcctaacactcaacctctctcctacctttgattatcataactccactctctctcccacccaggcacttaccacaatgtttgctgccttctgcacctacgctgctgagactggagaagagaggctgaaagcccctctcagaaaggcttgcagagaacccaccactactacaattactagtataaataataatgataataatttttgaaggtggaatagagaagagatttgagtgaaatgaagttggccctaggagctcagcttccatttcaagtcgtccctatcctcttttttcctccccattccagttagtagcaacagatggctctgctagcctgactttgatctagtcaccatccccaggagcggaggttaattgttaaccaaggatgctttgcatttggtgggtagtcagtacatgtttttgagggtagttattcttggtacaatagcaagctttgctggtgtctcctctccttatcctgtactacttggcctgcctcagctcctgactgggcctcccccaccagccccaacttattcctcagccccaacttatccctcagccccaaatcccatgaactgcatccctagcacaacaactcacccataaaggaagtgagacaacaggaagcaaaataattaatgttagcttaatgaccacaaactgaccagttgatctggataaattaccttgaacgtgcaaagacagaggagatcctaccaggctctcctaacaagcactgcacctgacatccagtgtaactatctggacaacacagacccgattgcagtctctctgtacctgtcagtctgagcagatctgtccacgcacctgccctcttcctcatcaatgaacaagttgggaaaaagatgagttcatgctcagtgctctgttcctcactcgttccaccttccattatcaagtctgtgacacaatggtgagctttcgctttaatatgatttgctagggccaggactagggtgaggtgagcgaggcacctagggcgtaaaattcaaagaggtgcccgctctcagggccatgcaagtgccttaccctcgtcccagccctgtgatttgcactctttaaagtaatatcagtttatcttcttcctatgaacaagtatagtccttctgatttggggtcgggggttaactccctatctcttgttgcaccaaatattttattgctacctatttttccattgctataagtctttgtgtgcctatacattaaagaatctttaatagtgttaatatcggaaaacatagttgatttctaagtaatatgctccaggtggcaagttaacacccatttcagcagggatgctcccaaggccagcccttcaacaaaagagtgactgagttgacggtctgtcaccaggatcctccctctcctctttctgctccattctcctaaaccttgcttcccagcaccaactctcttcagtgcctcctacttccttctcctcctaagaaaaacctgctctcaggaaagggataaattcatttactttgagattataaggcttaatgctacctcttttgagggtcagttgcattttaacaagggaaaagccttaagccaatggaatgaagttctacttgcagaatgttaggcatcaactagttgtagaagtgtatttttcaccatggaaaggccaaattccctgacgcctaactccagaatatagaaaatatcttaatcgcctggaatcatttgagttactagctgatggtcaattaaattgtcctgatatccaatgctattcaatatggttactaccaagggactctcagaaatggctactaaaagccactgagaaggcctagatcattcatattgtacattgacatttttacataaatggaattaatactacttaccatttgagtaaagaacacaaggaattgaagagtctgtgaaaatatgtcctgtttgtgaaaggtgaaactgtccaatccatgtccaatcaatgtcagtcgtccagtattggtggtgattattaaacttattggaggtacaactttacctccaataagcttacctttacaagcttctgctttccctgcttcatctctgttatgggctatcagtccagcttggtgtgaaaatgagactatatctataccacagcccccaatcctttcaaaggctttgcatgtatttcagctacaagtgacaaggatattagggatttaaaaggataagagagtgggaaagatgtataaggaagtgcctttgtcaaaaggcagcaaaaagtataatgatataaacataatatgaaataagcaaattttagaatactttgaaacagatttatagaggaatacatagtaaatagttatagacacacatttggggcatttttaataaggttagcaagaagaaatttgcatgagtaatgagcaatgtgaaatgggcattatacttttgttcagtaaagcccaaaatctaggccaatggttctcaaagtgcagttccaggagcagcaacagcagcatccctggagagggagaaagagagagagagagagtgtatgtgtgtgtgtgtgtgtgtgtgtgtgtgtgtgtgtgtgtatgtgcattccagtgatgttactccttcaagcccctgaatcactatagccacgactctccaactgattccaacctttaccattattctggctctcatcataaggaccagtctctggccaagaggtgtatattgttatcttggtcaggcatatgtttgcttggttttaagaaattatcagattgaggagtctcatgttttatgggactccggtgcatatgctcgaaaaaaattaaaaagaacttatcatattggatcaacaaattgctcaacctgcaaaatctttgattagacttagccagcccatctggcctgctttgggtttaaaaaaaaaaaaaagattttttttaactcacaaatggaaaaaagggaaaggtgttaagtttgtttggtattgccagctcttaaatacctgtctttaccgtggtggctgttctccagtaaggctctggcagaagtatatttgattttaagatttttgcctaaatagtagaatttgatagcaacgaactccaaaacaaaatctgaactggaacaactagttaacccctctcagcctctttgtaatgccaagctttatagacatttattccttaggtggtcttgagctttttctaacatccaattttataaaatgttgtgcatgcaaacgcagcattgtgctcattgtacaagtcacctcaaactcattccttcccccatgtgtatcatggcgaagaaatatcaatatatgtatgtgctgaggtcttctgatgaattgtaaattacaaaccttttcattcatttttaaatgagatatatttaccctggctagtggttaaagttttattctttttattatatttcactgctacttttttctactgactccaaagcttactttgggctatatttcttatttctagattgttgtatttatcttatttctatatttatctgcagtcttggaatgttagagctgaaagggaccaacctctctcatttcacacatgaggaagctgaggcccagaaaggtcaaataacttatatacaaggtcacacagtgagtcagtggtggggcccagcctcaattccaggtctcctgcccttgggcccaatctggtttcatttaaagcactacaatttatagaagacccacagctggcttctacttttatgacacatgaatttcccaggtatttcaatgaactaatatatatgctttaagggaaaatgttcaagagttctttaattcattaatccaaagacaaattggattttcagtttataaacattagtttccctccaaattcaatatgtgcaccctacttagtacaatggatgttttccctaaaagttgtgtgaaaaatgagttttttagatatcaagtatcattttttagaggtaaacttcctatgtaagggaaccttctggtgacttctttttgaaaaaccgagattcctcttgtcattgtcccataatgtctctactttttttagtgcaaacttttgtatttggtgtttatttaaaagtagggtacaacccaaccaatattagctttcccagagtctactttagccttcccttcttaatctttatgagaaattttcagactgttaaatgctcatgagatatttagttgtgttctagaaatttcacctggcttgatattctgtcaatccctgggctcaaattccagctccatcttatcaaacaataacagaattccctaatcagtactaagctccgcatgcagtctcttttccagaacattctttgcctaatgttccttagtgtggctctctctttagttggggcctccttccttagtacatgcataccttactattctgtggaattgcaagccatgcatcttttagagccacactagtcaaattgattggcatttccatttattttccattgttcccttgtttctcctggacttcctctcgtttctcttttcgaggatgcttagaggcttctcaccagagattggtgaggtttcccccatcatctagatgggagattgacaaattctgtaaaggttaagacagtaactattttaggctttgtgggctacatgtggtctctgtagcacattcttctttgttgttgctgtttgttcattcgtttgttttgcaacctttggataatgtaaaccactctctttttttttgacagagtctctctctgtagccaggctggagggcaattgtacaatctcggctcattacaacctccacctcccgggttcaggcaattctcctgcctcagcttcccgagtagctgggactataggtgcgtgccaccatgcccagctaatattttttttttttttgtatttttagtagaggcagagtttcaccatgttggccaggatgttctcgatctcctgaccttgtgatccgcccacctcggcctcccaaagtgctgggattacaggtgtgagctaccgcaccctgccaatataaactattcttagctcatgggctatgcaaagccttaggctgacccctgatccagactgtcttctgagacaagcatttctgtgagctgccccatgtgataactgagttgtgcagtagctgatgtggtttattgccttcccatctactgcattgtcagaccagactgactgcacaggagcaggtggaggggggctgcatatgccaaccattactcttcaatagagtgtccttcatgagctctctctctctctcattactgactacctcagtgtagaaaccctcatttttttccccagacctatccttgttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgttggaaagtctggcagcccaggccataggattccagttcagcctacgatttcctagggaaatcaccaggttccaaaggctggtttttaaacctagaatatccatgtatccatttcctaatgcagtttggacctgttctagacagagcactcagccttagcaagaaaaccaatgaggtgcagaagatattctgtgcccacagtttttccctgccttctggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcgtataaacgttgtgggataagaatggatgatatgtatgtgtctgtgtgagtttggtttctcaacctggactgtgagggctaattcacaaatcacaccatacatgcgtgtgtgcatgcgcgcgcgcacacacacacacacacacacacacacacacacagtccagcaccctcatcagttctctggtttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgcagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaaggcattccttactggcttgctaccagcaattgaactgtattctttatatagctagagctgtttgtgtcttcttaaaataaactttttctgttaaaatca

SEQ ID NO: 13892 - DNA, 5412 bp, Homo sapiens
  ENST00000366595
accgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcagttgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctatgctctcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacttggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacagaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaa

SEQ ID NO: 13893 - DNA, 5864 bp, Homo sapiens
  ENST00000264187
ggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcagttgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctatgctctcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacttggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacagaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaa

SEQ ID NO: 13894 - DNA, 1252 bp, Homo sapiens
  ENST00000305108
aatttgcttgataaacatgcaggatttctttgccagtcataaagctactagctcaaagcaggctgggtgacctcagatggctccgctgggactggaaggtcactggagccactggtgaaaatgatgctgtcactaccaactcaaaaggtcacctatcagtgtgccatgtgccacctcctggagcacacacatgtgcacacacatacactcacacgtgtgtgcaggtgcacacctcccccagaggctgcagccaagacgggcatcccacatcagagggatgaatggcaggtctgtcccgccagctgtgtgctctctcccacccgaagaaagcagcagagactcagacggcggagcctggaggagcccacgcagtctgttcccggcacccggtgcgtgtgaagggacttgagggcagcgagatggaatcagcaagagaaaacatcgaccttcaacctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcccttgctccctacccacagcacctgagttaaaaagtgatttttatgttattggtctaagggacttccatcttggtctgaagtcctgagctcagacgcaggtactgccagccataccttcctggtagcatctgctggacctaagtaaggcatgtctgtctaaggccaagtctgcccggcttaaggatgctggttctgactctaccccactgcttccttctgctccaggcctcaattttcccttcttgtaaaatggaatctatatctataaaggtttcttcaaatcca

SEQ ID NO: 13895 - DNA, 793 bp, Homo sapiens
  ENST00000397265
ccagtaattgcttggtggggcaagaggcttcagttccaagtcagcaaatgggatctgagtcatgatgtatatgcctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcccttgctccctacccacagcacctgagttaaaaagtgatttttatgttattggtctaagggacttccatcttggtctgaagtcctgagctcagacgcaggtactgccagccataccttcctggtagcatctgctggacctaagtaaggcatgtctgtctaaggccaagtctgcccggcttaaggatgctggttctgactctacccc

SEQ ID NO: 13896 - DNA, 670 bp, Homo sapiens
  ENST00000542920
gctaagaacaaaacgttggctttggcttcgttgcaaagcagccgctcggtggccgtacaacgcttcatctctccgagcctcggtttcctcatctccagccctaaaatgacgacacgccccacaggtcttgggaggattaagtgaggggacatgagcctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcc

SEQ ID NO: 13897 - DNA, 945 bp, Homo sapiens
  ENST00000433832
gttgcaaagcagccgctcggtggccgtacaacgcttcatctctccgagcctcggtttcctcatctccagccctaaaatgacgacacgccccacaggtcttgggaggattaagtgaggggacatgagcctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattggtgaggagcccagcctgcagtcagaccttctgcctcggcacccgtggctggcagaaaggccccacgtgtcccctgggccaccctgcattggcacaggcagctttgcaaccacacgctgacctgcagtgagccctccgctaacagaggcccaaagaccaacttccaccccgcgagggcaggcgccctgtcctgtctcctggtatcccatggagcagaccctccgcagtacctgctgaatgactgcgccagcacctcgctaactgctaactcactcactcgctcaccgcttctccatgagcactcgtccccacgcttacaggacccagcttaagttcccaaatcctggtgggatgaagcacactagggtgccccattgtactggttggcgagggcagaggcatctcagcccgatgacgaccacctcccttgatttctgccacatgggtttctgaagggcccctctctccaaactctggtgggtgttgtgggggcagctccgtgctgtggccccgtctctgaccctttccccccactccacttccctgcagcacggctgaacctgaatgaggtagaaaagcagtggcgactca

SEQ ID NO: 13898 - DNA, 323 bp, Homo sapiens
  ENST00000537416
gcgtggctcaaacgaccgccgctaagaacaaaacgttggctttggcttcgttgcaaagcagccgctcggtggccgtacaacgcttcatctctccgagcctcggtttcctcatctccagccctaaaatgacgacacgccccacaggtcttgggaggattaagtgaggggacatgaggtggtcatcggtgtcctgctcgtggtcattggtgaggagcccagcctgcagtcagaccttctgcctcggcacccgtggctggcagaaaggccccacgtgtcccctgggccaccctgcattggcacaggcagctttgcaaccacacgct

SEQ ID NO: 13899 - DNA, 1600 bp, Homo sapiens
  ENST00000435489
agcacggggcggtgactccagagctgggagcctggcagcgtcctcaccccaggaaggcatgcgcccctctgcgggcggccccagccctgggccccctgcccccggaattgcccaagatgccgggtgactcctccccggggactctcccactctgggacgcgtcactctccccacccctgggtccggaccccggcggcttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcaggcaccctctcgggctttgtcaccatcatcttgggcgtgttcatgctgcatgctttcaaagacctggacatcagctgcgccagcttgccccacatgcacaaaaacccacccccttctcccgccccggaacccactgttattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactg

SEQ ID NO: 13900 - DNA, 3274 bp, Homo sapiens
  ENST00000311946
agcacggggcggtgactccagagctgggagcctggcagcgtcctcaccccaggaaggcatgcgcccctctgcgggcggccccagccctgggccccctgcccccggaattgcccaagatgccgggtgactcctccccggggactctcccactctgggacgcgtcactctccccacccctgggtccggaccccggcggcttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggatggaggcttcggctacctgaaagatgcaatgtggtgggctggatttctcaccatggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcaggcaccctctcgggctttgtcaccatcatcttgggcgtgttcatgctgcatgctttcaaagacctggacatcagctgcgccagcttgccccacatgcacaaaaacccacccccttctcccgccccggaacccactgttattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactgtttccaggagaaaaatctttacccaaatagcaatggtggcagaacttcctggaaacagattcagtgaccaaatacccaagtttacatcagtgcctgcaggttccctggaccttccttctcattcattctttcggtgccatctctatgccgttgggaagaagatggagtctgacccactgaatgtagcacagtccaaggacttctctaagatattggtcattggaagttccttcacaccaattctcctcctgagacggaatctccgttgttgttgttgttgttgttttctagcccaaggatgacatagagctggctcccagaggcccacagagcaattggccatgcctccctatccagagctgacagggacacaaccagtgtaaaatatcctgttgcctttgtcacttcctctttggaggcagaagcaagacctcagctgaccttcttactgtgaaagccacttgatgtctcagggaaaaatttcaaccagctcattccccgagcactccagcctggcagtcagcacctcggcatccacccagtccatcccaccatcaccccttccccctctacttacatcctaaggagtcggtcactgagacataaaggcagtaatcgcagaactggaaacaaaacaataatagagccacagccaaactctggtggccaaacccagtgttgcattttgtcttactctgaaagaagaacagcaaattcactgcttcaaagtggcctggctgccaagctagaatttggcagaacgcactttactattcctcaaggagtcaaccaacctatgatctggggaggtgggaagaggatgaggagcaaagttgggatttggcagaaggcagtcccaggctctctggatactaggggctaacttttgtgttgactctggtgctcatctgggaacttaggagaaacgagctcaggggtaatttctgggttgcagccttaaaggcttggacagctgtgaatctcaatggccaactggaggtgcagacttggcatggggtgcattctagctgttgaccagattgctaccgagtcccctcctccactgatgagctgcccacactgggaagcagcatgccctgactgttccaacaccacctgctatggggagtacctttggtcccctcacatttggccagaggcatacaaaaaaccagagcagctggagagggagataattactattccttcccttcctatctcctttctagccacaagagtgtgggggttggagaagaaccattagaaagggaaattagtgggctggtgtatctggaaagagggaagacttgatcctcagccccgaggttggtgcagggcctcccctgtgtgactctacctgcactctgtgtttatatcctgtgccctaagtgggccaagcccaggtaaattcctgctggccttggaactccaaggtttggctgaccagcagactggctccctgactcttcagcctcaaatccccagtttttgatgaatgtggatttctgtctgtaattaaaagcaatgcaacaagttggctcttgagaatggcagtaaactgagggccctaagagtgtggtctgcagggtcaagaataaagattacagattatattta

SEQ ID NO: 13901 - DNA, 1151 bp, Homo sapiens
  ENST00000521390
ttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggatggaggcttcggctacctgaaagatgcaatgtggtgggctggatttctcaccaggagaacatcttaccatcaaagtcagtcttcatccatgaagcgtctactcccagagaggtttgcacagagctggcaaccatgaaggtgtattttctcaacttgcctttaaacatagctcgataatatcactgcctgttggtagtggactcttgacttctacatggtagaagctggaactcctaggccaacttcccccagtccgcaggcagttaatgtgttggcccacttagaacatagctggtccgttacttaaagtttgcccaaatttgcatactcacacatttcccccactttccacccaccctctcctgctatcaaaccctgactcttttaggtggaaaattaaccaggtttccattcataatcccctatgtcaagttttgatcctcgtctcagccagagctatcccagtgaccatctgcttttaaaggggagacccaggtggttctctatcagcagagagatggaaaaagacacttttctgataaccacacacagctatcacatattgagggtttactgtctgctaaactttctaagtgttatcctgtgtattaactcaggagtttacaaactggaaactcagatagagagaaagaacttaggccccttgggaatgtcagatttttcttttcctgctaattaattaattaatttatttattgagacggagtttcactcttgttgcccaggctggagtgcaatggtgca

SEQ ID NO: 13902 - DNA, 788 bp, Homo sapiens
  ENST00000519150
cctgctccggagctggggagcccgggcgccgtccgcccgcgcgtcggttcgtgtgccccgggccccatggagctgcgggtcagcaacaccagctgcgagaacgctgggatggctgagaggagtcagggaaggaaagttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggatggaggcttcggctacctgaaagatgcaatgtggtgggctggatttctcaccatggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatc

SEQ ID NO: 13903 - DNA, 567 bp, Homo sapiens
  ENST00000519946
gcgggtcagcaacaccagctgcgagaacggtgcgtacggcagggctggggaccaggcgggctccgcgcttcgcgccctcccctccttgccaccgctctccctcgcatcctctcctcccaggggggccaaagctggggaggggcagggccagcacgaggtggctcccacccagctttgaagatctgggttctggctgagacttcactttcatcttcgcagctgggatggctgagaggagtcagggaaggaaagttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggatggaggcttcggctacctgaaagatgcaatgtggtgggctggatttctcaccatggctgctggagaagttgc

SEQ ID NO: 13904 - DNA, 709 bp, Homo sapiens
  ENST00000476571
gtgggggctcgacggtggccgacgtgggacagtctggctgtggcaggggtctcggaaaccatgggttattgcagtggcaggtgcacgcttatctttatctgtggcatgcaactggtactgaagatggatggggatcattaggtttctcttattatattgtcccacaaatatcttaaccgtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaagcacccatctgtgaactggtggaaggagccatgtttatcaaacagagagtggaagaaagcaccagaactgcaaatccagaatttcagtctacagagtaaggaagggacaaggctggccctgcatctattcctgtagaccctgcaatgccaggggatatagcacaaggccattgtaagttccatgaggaactaggaaagagaaaaaaaaaagagaagcatctaaaaatatgttaaaagttcacatttctggtgctgttttggacattttttatgggaaagttctttgtaagtaatacaatatctttgaaagaaa

SEQ ID NO: 13905 - DNA, 1106 bp, Homo sapiens
  ENST00000368416
gtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcagtaagtgttggcagccaaccgctccttctagtgcctctggggttgttttatttctgtgcgaactcagtgcacacaaatggaatctgtgggtaaagtgtggcctttttgctttttcctcattaatgcgacttttaacaggaaatcctcaggttaaactaaaccatcctctggacttagtgtgctgattttcttcgacaattagtaaataccctttgttatcatcagcattttacataggaaatccaatcagtcaagatgtgattacgtgacttttggtagacttttccaaggattctgaagggatgatcagagatttttttcataacgttctacagtactcaaaattataagatttccataagtgttttctcttttagtgcttcttttggctgtgctgctagccctgggatttctctttttcatttgccctatctccttcttccttcctagatttctcccaggcaccatccatcacctttaatctcccactttttttccagaaaaaatcacattttctatagattctaattctaagacattcatgcccccatttttcatagtactgtaacaat

SEQ ID NO: 13906 - DNA, 3115 bp, Homo sapiens
  ENST00000368417
gtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcattttaaaaataaatggaaaaatacttaagtttctgagccatccct

SEQ ID NO: 13907 - DNA, 563 bp, Homo sapiens
  ENST00000640160
gtggctttgactcttatggctatcaagggcctcagaagacatctcatttacaactacagcctatgtacatgcaaattcccttggataacaactgataacaaattctatatatcagcatcaagtgatatgctgaattgcaagcgaagatcaaaatagaaagtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcac

SEQ ID NO: 13908 - DNA, 148 bp, Homo sapiens
  ENST00000546092
ggtttgtgtgctggagaggcaaatatttgacttccttggatatcagtgggcacctatcctggcaaattttgtacatattattatcgtcattcttggtttgtttggaactattcaatatagacctcgttacataacaggataccatgtg

SEQ ID NO: 13909 - DNA, 3052 bp, Homo sapiens
  ENST00000545433
cttatttgtccctctggtatatttacaggtactgaagatggatggggatcattaggtttctcttattatattgtcccacaaatatcttaaccgtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcatttt

SEQ ID NO: 13910 - DNA, 1268 bp, Homo sapiens
  ENST00000519049
aaagactcttaactagacaggccgatcctccccagcggcactccctttcattcttcccttcccaccacacacacacacacacacacacacccggacccagacagcccactccactttccagacgcccacctcctacatactcccctcccctaaacagacattcacccactcgccatctgtagcctccttccaaccccccgccccgcccgcctggctccccctccccaagaaacagacctgcacagtgggacgcagggacccccgccagacgctcgggtcgtgcgcacccctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctttggtgggttttgtgtatgcctgttatgtgatcagtatttccatggaagaagaagacacatttgatttcataggtggacttgatacacactcctactaccaggatcatgttgagttaaagcctgttaaaccagtcgaaataagtaatgacattgaaccagaaatgcggctgctgaacttgacttagggagcaaaggaccattgactgcgcgcctcggtggatccgacccgcctgacattccttccagaggctagactgtgcttcctggctttcccacgaatcatggagcattttggtcacagcctttgtattattagcattgttctctagatgagttctaggtgcttgggtgggtatttttttagtcgttttcttcttatatgaacacttgtaagttgtaaaaaaaaa

SEQ ID NO: 13911 - DNA, 1114 bp, Homo sapiens
  ENST00000523367
acacacacacacccggacccagacagcccactccactttccagacgcccacctcctacatactcccctcccctaaacagacattcacccactcgccatctgtagcctccttccaaccccccgccccgcccgcctggctccccctccccaagaaacagacctgcacagtgggacgcagggacccccgccagacgctcgggtcgtgcgcaccgcactgacctcggcccgccccgccgggaaactaacaaaggcgggcgcgagccccgagccctggagccgcgagcggcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctatatttttcctataggtttctgctgtggagccgtactcactgcagaccctgaaggaggaggaatacctgctttctgcccctcagtggtctcagctgccgttcttctcacatatgcatcatccatacacatcaagatgttttgcggctttatgtcagtatgagtaatcttggtcttactgtgtagatattctaacccttgaaggaaatgtcaaatgatactcttcagacaacgtactgg

SEQ ID NO: 13912 - DNA, 1988 bp, Homo sapiens
  ENST00000523211
agccgcgagcggcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctttggtgggttttgtgtatgcctgttatgtgatcagtatttccatggaagaagaagacacatattcatgtgatctgcaagtatgcaaacatctttttatccagatgctgcaaattattgaataagcaagaattagtaagatattatcaccaaattgtcacatcagtcaagcctcatgtgcttcctaagaactgaggtgatgcattattttagagtgtcattctaaaccccagattcaacatcttcctaatctttctagtgcagtctaatatataaattttatgaaaagcataggtttttttttaaccagcagtgctctttgagaatttacattgattcctaaagattgccattgctttgtataaaatgttataaattatcttagcatcttacctggaatttccactaaattcaccaatttatgatttgtgaaatctgattttactttttgaaaattttcatgtgaatttcccattttcagtgttgtagcacctctctcttcctctaagatcctgcaagctcatcaaaagccatgatcttattataccagcagttttatttattcaatctttcaacaagtagttattgaacttctataatgtgccaggctctggagctcgccttacaccaaacagacacaatcgatccattcgaagtgtcgtaattacacattgagggaccaactagaccttttctcattgtaaacttggagcaaaagtaaattcattaaaataaatttacattatagtgccacaaaaaaatgaacagaaccagaaagcattttttacaaaaattaacagaacagtgtgatagaggggaaaaggatgtgagatcatggtgccctaccttcaatagggtggccagaaaacacctctctgaagaagcagcatttgagctgagacctgaagaacgaggagtcagtgatgcagagaacctcaggagatgccttccaatctgagaaaagaggtgtacaagcaacatggtgccggcacctgctcagcttttggaaaggactcaggaagcttttactcatgatggaaggcaaagcgggaggaggcacatcacatagcaagagtggaagcaagagagacgtcatgctcttttaagcaatcagctctcaggtgaactaatagagtgagaactcactcatttctgtggggagggcatcaagctatttataatggatccatcctcatgacacaaacactgctatctcccacctctaacactggagatgacacttgaacatgagatttggaggggacaaatatcaaaactatatcatatggtttgcagatattttcttccatccttgagttatcttttcattttgttaattgtttcctttgctgtgctgaagctttgtttaatgaaatcccatttgtct

SEQ ID NO: 13913 - DNA, 414 bp, Homo sapiens
  ENST00000524201
ggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtggacaccgatctaatgacattcaatatctctgtacatcggtcatggtggagagaacatgggcctggttgtgtcagaagagtgctgcctccctcagcccatggcatgatggac

SEQ ID NO: 13914 - DNA, 1421 bp, Homo sapiens
  ENST00000370313
tccgtggctgtgcagcttgggtgtcctgtgctcggcttaggggcacaggcttgcgggcggacctagggacggcggaggcatcgtgtccttcctgcaggaaggaaggagcttccggcgctttcctgggaggctcgctggggccgcggagataacctgaggtcctgcaacaggctgggggcccaaggaccatcccaggccttggaacagttggtatctttcagtcgccgccctggagaggcaggtgtttgacttcctgggctaccagtgggcgcccatcctggccaactttgtccacatcatcatcgtcatcctgggactcttcggcaccatccagtaccggctgcgctatgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctca

SEQ ID NO: 13915 - DNA, 1430 bp, Homo sapiens
  ENST00000370316
gggtccaggctgcggcgcgtggggagcgggcggagcgggggcgggggccgagcgcggggcacccgggggcctcctgtataggcgggcaccatgggctcctgctccggccgctgcgcgctcgtcgtcctctgcgcttttcagctggtcgccgccctggagaggcaggtgtttgacttcctgggctaccagtgggcgcccatcctggccaactttgtccacatcatcatcgtcatcctgggactcttcggcaccatccagtaccggctgcgctatgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctca

SEQ ID NO: 13916 - DNA, 797 bp, Homo sapiens
  ENST00000466885
ccctggcagagatctgcaggtgaatggacaccaccctcctggggccacgtggggtcctttgtcccagcccgaccaaccctccaggctggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccac

SEQ ID NO: 13917 - DNA, 462 bp, Homo sapiens
  ENST00000470246
cctgaggctgggctggcaagaagcccctcagccttgtcgggaaccctggcgtatgcatctggcaaggctggcgccacgtgacccagcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctctt

SEQ ID NO: 13918 - DNA, 793 bp, Homo sapiens
  ENST00000370307
tccaactcccaccccgggccccggaccgcagctggtcgtagtggccgcggaggacggcagcttttgggggccgggcgggagaagcgtccgttcatccgcggaaccaagctgaggtcgccgccctggagaggcaggtgtttgacttcctgggctaccagtgggcgcccatcctggccaactttgtccacatcatcatcgtcatcctgggactcttcggcaccatccagtaccggctgcgctatgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccc

SEQ ID NO: 13919 - DNA, 506 bp, Homo sapiens
  ENST00000370317
gtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgaatcccagatggcttgctccacagaggaggaggaacccctggtggctgctggctggagtgggctggggccaaagcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttccccacaggccagaccccactgaga

SEQ ID NO: 13920 - DNA, 872 bp, Homo sapiens
  ENST00000486495
tccgtggctgtgcagcttgggtgtcctgtgctcggcttaggggcacaggcttgcgggcggacctagggacggcggaggcatcgtgtccttcctgcaggaaggaaggagcttccggcgctttcctgggaggctcgctggggccgcggagataacctgaggtcctgcaacaggctgggggcccaaggaccatcccaggccttggaacagttggtatctttcagtcgccgccctggagaggcaggtgtttgacttcctgggctaccagtgggcgcccatcctggccaactttgtccacatcatcatcgtcatcctgggactcttcggcaccatccagtaccggctgcgctatgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctgtgagtatggggcctctgcaggcagtggggcgggagacggctacagaggtggcagctctgagtctgtcccgtctggggcaaggcgagagacctccccacttggaagggacctcacgcccagcagggccttgctcacggccgtaggcctgagcgaggactcgccacacaccaggg

SEQ ID NO: 13921 - DNA, 663 bp, Homo sapiens
  ENST00000461738
tggcttctggggtgctctgcagtggaggcctgtgctgtccacgtgtaatgtcagcccggtgaggcgaggacaggtcacggcagctcagccagggatgctgtgtccgtacgccgacctgcgctggggctcccttgagctggctgtcccaccgcctcattcccggggcacccacgtgggaaagctctgagacgtgtcccagggtgggcttgggggacccctttctccatgctgtgcatctgggggccgccagactcaggagcagaggccgcccctcctatgcgatcatgggaccccttcccccgggggctggatgcaagcaggtgtgcccgggagctgtgttcagctgccgccccatcctctcctctccctagtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttg

SEQ ID NO: 13922 - DNA, 535 bp, Homo sapiens
  ENST00000472670
ttctggggtgctctgcagtggaggcctgtgctgtccacgtgtaatgtcagcccggtgaggcgaggacaggtcacggcagctcagccagggatgctgtgtccgtacgccgacctgcgctggggctcccttgagctggctgtcccaccgcctcattcccggggcacccacgtgggaaagctctgagacgtgtcccagggtgggcttgggggacccctttctccatgctgtgcatctgggggccgccagactcaggagcagaggccgcccctcctatgcgatcatgggaccccttcccccgggggctggatgcaagcaggtgtgcccgggagctgtgttcagctgccgccccatcctctcctctccctagtacacgctgtgggcagccgtctgggtcacctggaacgtcttcatcatctgcttctacctggaagtcggtggcctcttaaaggggctctctgctctggccagtgtagcacaggtgggcactggggcaggtgcccagccaggcagacgggcccccgcttcctggaaccac

SEQ ID NO: 13923 - DNA, 17105 bp, Homo sapiens
  ENST00000268459
gccaatgggcgcgcggggaggcgcgggccgcggcggcgggctgggggctcggcgctcccgggcgtcagtcgggccgcggcgacggcggcaggagcgcgtcccggcgccgcctcgggctccgctcggctcgggggctgcttcgggaggaggagagccaagggaggcgccaggcccgcgggccgggcgcatggcttagggacgctcccggccgccgcagccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccttctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaacctgaaaaagaaccagtcagctagccagggtctcagagaaaagcagattacacactcaaattgggtaatttgagcagagcttaataaaggcagtatttacaaagtgtgggctaagcctcccatgagagtgcagaaccctggggctagcagtgtggggcgctattcccacccctgggcctgagtggggaaggagttatctttagcagacagaggattgctggaggagtgagaggggcacctgaaggagctgtgacctttgcttaaaggatgcagccagtcatggggaccctccagggaaattaatatcctgacctgctttcctgccccccagccccctcaatccattggctgaggccgctggaagccaccgggccaagggagcttgttgatgtgggtcacacgggcatgttcccaggtcagagaggagagtggagagtgaatctagggagactcaagagggagaagtgactccagctaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcccatatgcattttgttaatttttaaagtatttcaaacacaaagtttgaaacagaaaattgtgtaacattaactatgaacttaccacccagaatttacaaatgctgacattttgcaatatttatttcggatctatttttaagggggggaaccctgcagttactgcttaatcctcttcccaccccacccttttatttttacacaaggagcatagtgttcatacttatgctatttttttcagtaactgaatatatttggagatctccctccctaggtcatagagctctgcccccttctctctaacagctgctcagccttctgtgactagaggtgctgtcaccagcttgccccatcccctcctggtggtcataagggtcatctctcatcccaggctctggcgaacactgtgctgagagtccttgcatacagctctcccggtgcccacaggcaggaacacaggcgacagaaagtttccacgtggaactgcagagttcaagagcaagtgtgatttcaattttgatgagattgtacatgacctctaaaagaggttatactggccgggcacggtggctcacgcctgtaatctcaacactttgggagaccgaggtgggtggatcacctgaggtcaggagttcgagaccaacctgggcaacatggtgaaaccccgtttctactaaaaatacaaaaaattagctgggcatggtggtgcgtgcctgtaatctcagctactcgggaggccaaggcacgagaatcgcttgaacctgggaggcagagattgcagtgagctaagattgcaccactgtactccagcctgggcgacagagtgagactccatctcaaataaataaagaggttatactgaataatgaggaatcaaaggaagaagaagaaagagagaggaaggaaggttggaaggaaggaaggagggaaaattagaaggggaaaccatgattgctggtgaggttttgagcacattttcctgcaggctggtatgggtgagaggtttggtcttgtttgcaaatcttctgaaggccattccagaggagcagttgccactgccccatcccctgagctctgagcgtgggggttcccctggggagactcctggtgagaggatgccgatttctgctgatctgtcactgggtaccgaggactgggtgtgtttaaggcagacagccaggtgaggatcccagctactggggcctgctgtcatctcctgggagtacccgggggtcaggagcctaggggactcttgcacttcacatccagccatgctaattacactttttggcaaaggaaacagctaggagcagtttctttcactcctacagccccgttttctcagtgtttagacctcgaattattactgggctagagggaaggcagcctctgaagtgtggcaggaggaggggaagtctgcctgcatcttggtgtgtctgtcagatgccagcactaataacctggcttctgtgaggcctgtcagtgctctcaggaatgaaaggggacccctgagaggtgctcagtaccagcaggctgtgaatgctctctacccaccaccctcacctcctcgttaaagatggtgctacctgccacacagcagacatctggtcgctgcacacccgaaagaccccaaggcagtctgccccttgtccagccacacgccagcacccaccctcctggcccctgcctcggcctccccagaccagctgcacccagcccccaacacgcaccccttctccagatgtgtgcagggcctcattttgcagagcaaagacagatgtttcagccacacgctttattaacttctaaaacctgtgctcaggacactcttcaacagtcatgaaaagtttgatcacttgccacagtcaggacctttgtgtggggctctgatctgatgttcggtctcatcatctcccaaaccagcagtcgtttgtaccccaaccctctgctcaggggctcatacccccaaatgattttcctgatttatgtatttccctacaaagggctttctatacctagcatctgcctccagcatgagaagggggaataggtgagacccatttgccagtagcagacggggaccctggggagaaaatggcagagcctgttggagactccctgtctccagctgaccagccaatgggattcctcttccctccactgtctcccacaaagtagaagaatcctggtacatttagcccatgagcctggcacagatccctatctagacatgaggccctttagacatgactttggcattgaccagcctgttggcaatgggtcggggaggcagaggggatgctcacaccagtaattctcatcccctgaatgcttgggatcacctggggagagttcacaaaatactggtgcaggggtcccacctctgatgatgctgagtggtgggtctggggtgtggcccaggcatcatgatgtttcaggcccccaggtgacttcttaggcagcccagctaagcccctagagccttgcaatttcccccaaatgacctcagagggcccgatttgagggaaatgcctaacttcaggggccgtaagaatcccccagggagcatgtgaaatgcagataccaggcccacccccagagatgagctgaggtgggtcaggggtgaagtgcagggatcagtgtttttcacaagctccatacctccaggaaatggtgttgtggttgggcccgtagaaaacattctgagagtcctgttgcctgtgccttggtgcacgtggggtggaatcccagtggccctgccttgaggaggatgtgcattaacgtggtaggggagacagagacagctccacctgccccctgccccaccggggacctccaaaaacttcatggatgttagagcaagcagccatgctgcagcagaggatgaggctggcggatttagtaagagccctctgtgtttgggctgagttctttctctagttgccctgtcatctggcctctggataacccacctctcctccctcatcctaaaattacagatggcgaaagatggccacatttagtgagacccctaaggtcctccaactagggtgggtccacagtggcccctggtgcatggaccacacactctcttccctcctctggctcaggactacggtctgaaattagggagatatgaatgtctttcttgaaaacttctcttcccagtcttcccactttgcttgggggtccttggtcaaggccagctttggggactagggcttgttgcgactaccagctgtctcattttgctgtactgcaaactcaggcttggttccaagcttatgggggccctgtccttcccctagtagggtttgttttggggtcacatctggtcatacccttcagagagctcttccccagcctctacatcagggagagaggtaggtagggaggagcattcaaggattagaagaaggactaaagtacaacagccttggaggaactgccaggaactaagggcgagcactggagaaggcaacctgggaccccctgcgcttctgagcaggaagaccaagaccttcaggggccctaagcactgaaaacatcattcctcatccccaagccctggcatccccctgttcttctaaaataattcttttctaggtatttctgattgcaaaattctggatgggttcatccaagctgacctttgctgttttttcccttcccaacaaggcctcactttttggagccaccttagctggtgcctaggcagaggggcagtcagcagtggttatcaggatcctggctctatgggttgccttcctcctggtctgtaaagcccctgcaggcagggacttcttagatagctgcttccttagggcatggcatgtagtgggtggttaatgaatggaagagagggaatgagtgatcaagggagggaggagggagtggagtggagatttctcatcctttcctgttaatttatgacatcctcctgcctatgagtccttgactctggagttttacaaagcagtcacatttcaaataaaagtctgggaaagcaacacatcatcgccaacttttaattttgctaaataaggatattagaaaaagaatagaaaattgcagtcccttactgtttaaagaaaaaccaaaagaagttaaaaagaaaaaaaaaacaacctcattatgttgtctttgtttttgttttgttttctttccttggaaatcagtgaaagtttggtcagccacacattgtagtagggctagaatttttcttcccattttagagacgggagacctgagactccaggtgggggtgtggagtccaaatggacagttcttcccaaagctgagcgcagaccggcttgcaggtcctttttccagtcatggcctcagctgtctgcaaaggacttgggggaggctgacagctctgatgtctggagagggggcttctgcaacctccaacactggtcagtaactccacagaggccattggcgggggtggtctgcttgtatcagcaggcctgtcatggccagttcaatggtcggggctgaactatgtctcttggtgcctggtagaggggttggagtgggcctgaggccaacttgctcagagccacactccccaggaagctgtggagtctggaactctgccctgccttcctgtcccctgcccactctaagcctccagaagtcaatcctctgctcaccgggaccgtacctagcctggcccatcgatgtgtcatgtttgacccatcaagggtttcaaaaatttttaattaatttccaaaatctgagggtttcacctaaaaacctggatgtttggcttttctcataaaaatcagaaagtgggtttaccccaggctcctgttcccacatggctgcaatccgcccgcctcttccaatggtgcacatgccttttttcctgcgcccggagcccctctcagcctgattttgaggcctggctttgatgcgattcagctcatgacccctgcgcagcctcaagcacctaagttttggaggtcagtgatgccacttaaaaacctgttcagggcagagcgttagacaggaggatggctaagggagcagcttcaggcatgggaggactttcatggggaagtctttggggcagtcctggagaccctcacaatgtggccccactcctcctttagatggggcaaggtgggctggaacccccagcaaagggtcccaggctgtgtgagaccccgcccagcactccttaaacagccaagacaggtggaaagccccaactcaaaagactggctggattgtacccggctcagtgacttcccctctttgagactcagtttgcttttctgtaaagtggacctaatgaggcccgcttggcttcagctccagggactttggagatttaagcaaagcaagaaatgggaaaggagtttgttacatatcaggcttcctggaggaatgccccccagctctcttggagggggaagcaaaaagactgctgatcaggcaggggacgggaactccccgagtggccacatgggcagtctcagtaggagtctcaggccaggctctgtctgtggattcccacttctctgggctgcatctcactgttcaggctagagtctggtccttgcccatctgcaggtccaggaagatgtggccccaaattctctggacctgatgtcctagatcctgtgcacttggcttcatggatagagtctgagaaggttgcaggatccagtagctggaccacagaatgcagcctgggggtttggctaagatgagcagactggcccatggttgagactttggacctgagctgagtcctggttctactacttcctagatgtgtgacctgggacaagtgactcacctctgtgccttggtgtttttctctaacatggggctaattggggtaactaccttactgagctgttatgagtaaatgatccagtgggcgtgaagcgttcagcgcagagcctggcacgtaataggccctcgataagtaaaacagcaacagtagctgcagttaggagaatgtgaccccagaaggctcatgggaaaggaggtgcagtcctgatggatgaagggtacctgtcctccaccccggctgcagagcccccagtgagacagctgctgtggcatgctgcctctgctacacactcaaaaaacacttgaggacatgacttttccctctcaagtttgatgggatcactctgttccttccagacccgacttgtggtgtgaacttggacaagcccctgctgtctctggccttcagtaccatatttgtattatgaaactgcccttggcttgaagctagactatgggggtggcagctctaagtcctacaaacagtaggggtagtggtggggatgggcagcctgaaagccatgccagcagtgccttccttggggaaagaggtggcctctggagcaatgcttcgctaccctacatctgggtctgtccttgcccaactcctaagctgcaggatcgctgaggagtccacattgccatatctgccacttacagagtgcctactgtgcacccagcccacattcactagtgtcctcaaaacagccttgagaggaaaccaacgaggaaacagagttacagttcagttaagcaacttacctaacttgtggctaatgcatggtaggattaaacataagcctgacatatgctagccacatgaccctccctttccaggagcctgctggcattgatacaggttgacaaagaccagtcctactccgttgtctgccattactccagccaagtccagggacacgtgaggcaaggggagctggggctgctggtgtggccgagacctcagcctcagcaagatggtgccccaagctctcagggtgccctgtggtccccttcattcataacattgatcatgtttgtaactgtagttgattctcactcatcgcagtagttacatcttataaagtcacctctgacactgagttagcgcatactgaactactgatcctaggggaaatacagggttaggttcctgccagcttctggtcacaacattttcattaccaatcagtgcataaccttgttttatgtgtgcttctgtttaaagatgcctaatttactatatattcttgattcgttaacattgaactcagccaacagctctataactcatgactgaatgaagcttatctagcacacatattttctctgcaaggcatatcagagccttctgtgcttaagagcacaagatggcacttcagcgtcatgcctggggagcattttaagcagccaaatcaccaacacaaagcacaaacatgcacaaagcatgatgctaaacagactgtgagaaggatgtttgtgtataggatgagaactgaaccacgaaagcagagcatcatcttgttcgacctcagttgagaacatgttgtcgggccactcagacttttcactgctctgcgcatatcacgaatgaagtgaatgcaccatgagtattgattttgggtgatagacaaattttagtgaataggcaatttcgtaaatacagaatccacggagggtgaggatccaccgtatgtacttatctatgcctctaattatttggtttccaccaaagcacttgttcaccagattatcttataatcccaaaggcccagcaaagacaggtgcttgttcaatgtctgttgagcgactgaaggacaacacattcctggcctccccacccgcccccagcgggacctagcacatggcctgctgttgacactccatgtgtctttgttgatagaattcataaagacagatgggaaaaggggcacccctcttgcgggttcctgatgctgagagttgttggaatgttgatgctgcccccagagaagggtgacagcatgcagacagactggaaacccagaacctcctggggatattcagatggtgtcactgggctcggcctgtgggctctcagcacatctaggtactggggcccagggtgactctgagtggctcaagtcccctggccagatcctctccagatgggcccctggccatcttagccaacatcacctgattctgtttcctctgactctgtcctcaaaaggcagcatctgattgtgatttggtccagaaattcctggccagaatatttccagtgtggtgcatgtgaacttcccgccttcccttccttccctcctccctcctttcttcactggggagaaagaatttggcattcgagtatctcaccccgtcttgctaagcagtttagttagactgcaggccagtctctgtggtgtgaccaccccccagtggcaaggagctgccaaaactgagcttctgggcaagacgtgggcagagcaaagagagacccacacttggcacttcctgcccagaaaggacctgctcaggcctggctggcctttaccaccgtcatctccaggctttctgttcatccgtactttcaaagatttagtgatcaagtactatgtgtcaggaaccatgctcagcactcgataaaacagacatcatctctacctacctttgtggagctttaatctagtgtgggggacggggggactgcttccacccagaaacgacatttttatccactgcgataacttctggggagacatgggagggaataacagaggggacatgatggagatgggggactgcagagggactctccaggaagccacatttagggggtgacctcaagggtgaggaagaattagccaggtggaaagttagagggagcagctggtacaagggcctcaagggtggatggagggtgaacgcttgatgaactggtgcaggcctgtatggccgggtacagctggcaacgaggaggcccggtatgggcagaatctgggggcctgaatggtggagagtctgcttgtcaccccaagagacacatcaggaagctaggtggtcagtcgggagagagaggatgtgacactctagccaccaccacgcagagaagggattggaaacagtagcccggagaggaggctctcttggtaggatcccacggcaaccgaatggatgcacgttgtttatgacgttcttacccatgaaagcgctcaaggatccgcttgcttgcttacatgtgggatcagcactaccttccgtgctgccgaacatcttcttaagcgagggaaagaacaaaaagaaaagttggcaagaaagaaagggcaaagacagagagactgggagagaaagaggccccaatttcctctctctggtagttgctgaattggctctcgtgaaggcagaaagggaagggctgacttatgtccctctgccaggagaggggaaaggagggaggcatgatattgacttaaacgtgggggatttaaaaggcccctatgttcccactttgtgctttgcttctaacagacagcctgggacctttgaagtcggtctggcccagtggggagcgggcttctgtggagacaagatgctaacgggggcgggggaagggggccagggggcggccgaaactctattaggcatgctctagcaaaaagaaaggcaaatccaatgataatgtacatctgtttcagggaatttataagctttgaacattttttatgggcagataagtgggtccttttcttaccataacttagaacttcaaagctgagtgtgtggataatgcaaattgctgaaatatgagattttccctacaaagaggtttccaaaaaagacgaggaagaaaaagaggggggggggagagagaacgaaggctaactgatgccacagtcttttatgtacatggcaaaaacgggacagaaattgatttttatgaaagaagaaattgatgggagacatggcgtggggaggaggcggccttgtggcaggtgctgggaggcagggactggggccgggcgggtccacccaggctgtgggtcagccctgcagggttgagctgcctggctgtggctcaggccctggggacacagtgccctccctctaggagccttaatggggaaaacaagaacactgtcactcgtaatgggcatgaaaggacacttcagagccagccaaggcagtgtcagcccagaacaacaccctggaacacccaagggggctccaaggcaggatgggaccccctggtttgggaaaatcagaaaaggcctcctggaggagaggggctctagggggcaggtatgatcctgaagggaagacagtggggtgggacatttcagatggcaaaacagctgggtcaggatatccccagggtcatgcctctgccacccagaccccaccacattcagccctctgtgcttttcttgtctcccacatccccagccccagtaactagcagggacacagtcaacattcaatatgtgcatgttgaatgaatgaatgaatgaatgtgagatcgtgagaacacacagctggttggcaagcagcatcaaccagctctttcttttcactatattacatatctacagtggtagagtcatactagaagacatgatgggatggtggtgtggtctctgtagttgaccccatcatcctttctgtccataggtgattcgtctaagccagacatggcaaagtcctcacctttgccagtgactgattcaggaaagatcatgtgtgaccttattctgggcaatgagatctgaagggaagtctgttgaggaacttgtaacatgtcatggtagtggccatcttgctacagcctgaggaccacagagcacacacagagagtgctgggtccttgggaatgatgttgagcaagcacttatacatgacctggcagccacccagcatctgtactttagttatttggtttttctcaggaggagatcctgagatgaagactcaggagcaggttgttgattttgaggtggtcctgggaaagacagggaggagagtggggaagtgaggcagaaaaggaagggaagttccactccaggagcccacgtggaacatacctcagagttatcccacctgcacagggagggagctgaggtatttacccacccatccttgtcagtcattggtcaagggctatttctgtgcataggcataggcttcagcagaattgcaggtactggcagtcggaaattggaccagcaaacagaaatgattcctacaggggatacaagccaggcacaggcagtgtctgttacttggggttcctgttgcttagagttgaaagcatcataacccatcccaggtgatcatagaaggacctcaaaggaaaaggtgaggggtttggacatttcctgagaatccatgggggaaccattcagggtttggggcaggtgtcaaccacaagaacattaaacaggctcttttggcagcaaagttgggagtggtgttgaagtaactgggaaaactccacagaggctcagcgtccacctctacctgacaccctgccagcaacctgggtgatttccgcaggtgtctgaaccccgatctctcagtgttatggcccccaccaccaggaaggcctccttttctctcttctatagccactcactcctgggccccactgtgaacccagaaatgccacaccatggaagccacacactctgctgtctccttctgtcctcattcctgtccttctcacagtcagtccctcttggctcttcctagagtccctttcattccctcatttccacttcctgccgctgtactgtcacctgtggcctggatttgcactcttggtccaacaccctcaactccaacacctctgtctttctgccccatccactagacaaaagctgactctggaaaacattaggcactcagaatcaagggttctggggtcagatggataattgccatcatcctcaccaagttgccactggactttcttgcccctaaatccactgggcatttcattgctacctttcttgacttcttgattgtttttgtgatactgacacatcccccctttcagaacaccctctgcccttggattctgtgcacaggaagctagttgctcccctgaatacactctttcttccttgtaatacagcctctgattttgagcccaagaataaagactacagttctcagactccttcgcaaataaattttgtgactaaactctagtcaacagtaagtgtcatgtagcagctcctgggaatctcctttaaaaagagagcttgtttatacctattgtcatctctgttcttctgtgccccttcttccattttgctgcctggaaagcagatgtgatggctggaattccagtcaccattttggaccatgaggacaacaccctagagatgtggagtggctaaaagaagcctgtgttcctgagaacttagaggaccaggacctctattccaggcttggacacctacatttagactattatatgaggaagcaatcaacttctcacttgtttcaaccactttcacttgcagtcaaacctgaattgtaagtgaaattgctttcctgatagcaaacctgttggattttctccagaatccctgggccacttttagcagtcagattcgtctaatcctcctttaaagatggtggcagtgaaactggtacatgggacctgactgggctttgtttgcaactttctgataatttataattatttcaaaataaaaaaattttaaaaata

SEQ ID NO: 13924 - DNA, 477 bp, Homo sapiens
  ENST00000564336
agtcgggccgcggcgacggcggcaggagcgcgtcccggcgccgcctcgggctccgctcggctcgggggctgcttcgggaggaggagagccaagggaggcgccaggcccgcgggccgggcgcatggcttagggacgctcccggccgccgcagccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagctgctgtcagaaggttgtggactcaaacatcttggcaagcaaccctgagactaaaatatt

SEQ ID NO: 13925 - DNA, 748 bp, Homo sapiens
  ENST00000566396
ttcctttgtctttgaagacccacagaccaccaggcacccctgcaggcatccctccccaggccaaacctcccctgcccgggctctggctgccctcctgggccagttctgtcttggccaaagtgctccctgtccactcaaggtctggggagggcagaggacaggtggccgccccttggcctggcctctaggcccaggcttccactacccagtcagtgttgccacagataggggaccagccccgcccatctctctgcatccaggagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaact

SEQ ID NO: 13926 - DNA, 564 bp, Homo sapiens
  ENST00000585955
acttggccctatattttctcaaaattcttgtttctctggcactagttaacatgtggatctgaactaaagcactaagagagaacctttctctgtactctacctttgctccagttatgattatctactttgccatctgttagtatcagggttcaattaatttgccggtattgagaattctgtattcctaggtttatcccttccttaacttatttctcctcccatctcccatttcttcacatctgactacacttagtgcacagcaaaaggaaaatagtgtttctcactgatttgggttccaggtcaaagataaattcccactcagtttggaggcttactgaaatgtctaggtgcttgctctgaaacttcaagaggaagattagaaggacacattcctaagaatttaaaaccaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccat

SEQ ID NO: 13927 - DNA, 2948 bp, Homo sapiens
  ENST00000307641
cgccgcgccgcttcccccacctcgcaccagacctctgaaattgccctcggagactcggcctctcctataaggacgatcgtcctctcagctggagaacaaggccatgcctcagctcctacgccaggcggaagcgggagaggaaggccgacccccaagagcgccccttcagggggtccatccggccttgatctcagatgggggggtgtttgcggagggcggggcatcgcctcaacagctgggggctgcatcatggcaggaacgagtttccctgagccacggagctgcaggtcgcctcctctactaccctgctacccggttacctcttcgcctcttggtcgtcgagcagctccggctcggtcgccgccattaccacatcgcactccgcggcagccgccatcttaccgccgggaccagagagctgggtgggaggccggcggtgaagagcacttccggttggagcatagagcagctccgcggcgccgcgcccagaagggctccctcgggctcgtctaccagagagaggctccgcttggggccagagcggcctcccgcccccggatgtccacggtggtctccgcgccggggcgggagcccaggggctgtgccggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaaaaagtt

SEQ ID NO: 13928 - DNA, 1909 bp, Homo sapiens
  ENST00000393885
gacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctgg

SEQ ID NO: 13929 - DNA, 563 bp, Homo sapiens
  ENST00000587337
aggcggcgggggcggggcctggaggagcctacaccgactctggaggaagactggagcctttgcggcggcgctgcccctcccctggtccccgcgagctcggagggcccggctggtgctgcgggggccccgggaggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtc

SEQ ID NO: 13930 - DNA, 997 bp, Homo sapiens
  ENST00000485789
cgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctggg

SEQ ID NO: 13931 - DNA, 992 bp, Homo sapiens
  ENST00000479407
cgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctggg

SEQ ID NO: 13932 - DNA, 1644 bp, Homo sapiens
  ENST00000393880
agcctacaccgactctggaggaagactggagcctttgcggcggcgctgcccctcccctggtccccgcgagctcggagggcccggctggtgctgcgggggccccgggaggtacggacctgggaggcgaggctcgtccggcgctaggatcggcctccgcctccgggccgctttaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcg

SEQ ID NO: 13933 - DNA, 1598 bp, Homo sapiens
  ENST00000393881
agcctacaccgactctggaggaagactggagcctttgcggcggcgctgcccctcccctggtccccgcgagctcggagggcccggctggtgctgcgggggccccgggagcgtgcttctgttcttcaaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcg

SEQ ID NO: 13934 - DNA, 585 bp, Homo sapiens
  ENST00000462043
tacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgcccc

SEQ ID NO: 13935 - DNA, 535 bp, Homo sapiens
  ENST00000587028
acaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggtgagtgttgttggagggggaggaacagtggaagaagttgaaaaataaggaataggacttgatcacaacacacacaggctaaaagctgctcctggtggttttcccccctggaagaataaaacttacattgtaacagatcaactctacaacactgaacaaatacggagggagaaagccctatgtccaagataggaaagagaagctgtcatgtcacacttgtgcttagcatggaattagcataaaattaatgtccattggccgggtgcggtggatcacgcctgtaatccgagcactttgggaggctgaggcgggtggatcacctca

SEQ ID NO: 13936 - DNA, 1041 bp, Homo sapiens
  ENST00000491638
accgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtggacagttttctcattttataccaggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtccctt

SEQ ID NO: 13937 - DNA, 1461 bp, Homo sapiens
  ENST00000449471
cgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctca

SEQ ID NO: 13938 - DNA, 833 bp, Homo sapiens
  ENST00000316082
tggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggagggtctcactctgccacccaggctggagtgcagtggcatgatcacagctcactgcagcctcaacctcccaaggcttaggtggtcctcctgcctcagccccctgctaagactacaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctg

SEQ ID NO: 13939 - DNA, 4213 bp, Homo sapiens
  ENST00000393879
gaggtttctgttagggaccgtctttgggagtgatctatctctgctctctgggggggatctttgtctggagcttttggggggcttgtgtttggaagtttgccttcggggagatatctgtctgggacctcttagggtttctgtatctgagctttctcttttgtgtctgtcagtccaagggcagcaaaaagtatgtcctttctgaagcctttttttccgtaggtttcttcattcttttctctcttgtcttatgttcattttagccatagacttgactggagtttagagggaattgattgttgtccagatgagtcgtacaggaaagcagattgtctttttttgagacggagtcttgctctgccgcccaggctggagtgcagtggcatattcttggctcactgcaatctccgcctcctggattcaagcgattctcctgcctcagcctctcaagtagctgggattacaggcacccgccaccacgcctgactaattttttgtatgtttagtagagatgaggtttcactatgttggccagtctggtctcgaactcctgactttgtgatctgcccacctcggcctcccgaagtgctgagattacaggcgtgagccaccgtgccctgccccagattatcctttttatttgctcagtccccccagggagcagatggcttcagacagccacacaaaacactgttcctgcttaattctccatggggtcatggttaaagagaggaagctgggctgagctccctttactaattggtcctctacatcttgcgcacagaagggaacctggcccagtggccagtgactctcctctccctttatggcagcatttccaagcacctgccctgtgacagatactggctaggtactggggataacaaagacgaataaaataacagcttaccatccagtagtagacatggagacatccgtttcctctgactagcattgggatggtgctgaaaccctggaactatacattcagtttagaactatacattcagtttagaactctcagttatggacgttctgccttctgtttttttggtttttgtttttgtccaccagaaaacatctgctagtaactgccttctgtgttgatgctttctttcctcaccttacccagcgtgcttctgttcttcaaggttgaaaactaagcatggggaagagctgcaaggtggtcgtgtgtggccaggcgtctgtgggcaaaacttcaatcctggagcagcttctgtatgggaaccatgtagtgggtgagtgttgttggagggggaggaacagtggaagaagttgaaaaataaggaataggacttgatcacaacacacacaggctaaaagctgctcctggtggttttcccccctggaagaataaaacttacattgtaacagatcaactctacaacactgaacaaatacggagggagaaagccctatgtccaagataggaaagagaagctgtcatgtcacacttgtgcttagcatggaattagcataaaattaatgtccattggccgggtgcggtggatcacgcctgtaatccgagcactttgggaggctgaggcgggtggatcacctcaggtcgggagttcgagaccagcctaacgaacttggagaaaccctgtctctactaaaaatacaaaattagccgggtgtggtggcacatgcctgtaatcccagctattcgggaggccgaggcaggagaatcgcttgaactcgggaggtggaggttgcggtgagccgagattgcgccattgcactccagcctgggcaacgagagcaaaactccgtctcaaaaaaagaaagaaattaatgttcgttcccctaaacccaaatcatttcagtcctgccaggctgtcaattctctggcctcctcagccccctacattcctttctccccatttggtcagccttaagatgctctcatcactcacatttcccatctctctctccacttcagacagttttctcattttataccaggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaaaaa

SEQ ID NO: 13940 - DNA, 3741 bp, Homo sapiens
  ENST00000371527
cagaataatgacatggttccttccatcctccaaaggtgaccaataatagtttgtaagtatcattatgaactaatgaattttcaacatatttgatatatttcaatccattgccatcattgttcttatcgatatttgagttggctcactttgccagtaagagtctattcaaattggcttctgagtccatttgacacaacacctttgatctttgacagtttccttggttttaggtgctagatgatttctcaggctcaccttagacatttcctgccacagacttagaatcagccatttctctaaggaccctgattccatttcatgagaaatgatagagaccacaatcaaaacaagtcatgaatttatactgatattttcaattcaaattaaagatgaggtttttgctaaatttttttgagtttatatttgtatgtcttatgctgaaaaatcttgtttcctaattagtaacataattattcatttgatgggtaaatattttagggccgattctttggttttatagccaagataccctgttgataaagtcttgtgggagcaattataagactggcttattttgaagctttttaaaaaagacatccttacctgttttaactgtagattatattaacttaaataggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaa

SEQ ID NO: 13941 - DNA, 3269 bp, Homo sapiens
  ENST00000304449
cgagccagtgctggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaa

SEQ ID NO: 13942 - DNA, 390 bp, Homo sapiens
  ENST00000487600
gtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttga

SEQ ID NO: 13943 - DNA, 3351 bp, Homo sapiens
  ENST00000542113
ggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcagcttccatatagaagaaagggaagggccaatgaagactcttggaagctagggaccaagtgcagtctttagatgggctttatgttacctctcatcttcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatc

SEQ ID NO: 13944 - DNA, 2092 bp, Homo sapiens
  ENST00000377142
gcggccgccggagcccgagctgacgccgccttggcacccctcctggagttagaaactaaggccggggcccgcggcgctcggcgcgcaggccgcccggcttcctgcgtccatttccgcgtgctttcaaagaagacagagagaggcactgggttgggcttcatttttttcctccccatccccagtttctttctctttttaaaaataataattatcccaataattaaagccaattcccccctcccctcccccagtccctccccccaactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgtttaaaaaagaaaaaaagaaaaaa

SEQ ID NO: 13945 - DNA, 1862 bp, Homo sapiens
  ENST00000395855
gggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctca

SEQ ID NO: 13946 - DNA, 3913 bp, Homo sapiens
  ENST00000374051
gggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactcccaa

SEQ ID NO: 13947 - DNA, 3046 bp, Homo sapiens
  ENST00000358741
ccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgtaaagcggatttccaaggaatgcgcccgaaagcccaacaagaaaatttgtaggaaaggaggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacaca

SEQ ID NO: 13948 - DNA, 3153 bp, Homo sapiens
  ENST00000476589
ctccccgtgtctggtccccaggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactccc

SEQ ID NO: 13949 - DNA, 3863 bp, Homo sapiens
  ENST00000536169
ccctcggtgcgcgggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactccc

SEQ ID NO: 13950 - DNA, 3319 bp, Homo sapiens
  ENST00000612180
ggtgcgcgggcacagcagccaggctgccggagagctgatctcggggattcgggtgcggagcccttggcctggaggcgatatgggtggtccgtggcccggttcagtcgcttgcagcagcccggggaacagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacact

SEQ ID NO: 13951 - DNA, 793 bp, Homo sapiens
  ENST00000471252
tctgtctgttagtacagagctcttattcagccactagctcggcctttcctgcttcaattgtaatgcttgttctgcccggggacacactattgacagcagaaacaatgaatttcctccaaacccggcaatgttggtggctcttgcattcctctggatgagcgaatctagttggggggttcccgaaggggaaggcgcctgggctttcaatacatcctcctgaatcatactgcgtttcaggttccttagaaaaatttggatgtgtaaaaagaactcttaacggcgatgcaggtcttccacagctaaggttgcattggagttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatc

SEQ ID NO: 13952 - DNA, 6617 bp, Homo sapiens
  ENST00000382872
tccaaacccggcaatgttggtggctcttgcattcctctggatgagcgaatctagttggggggttcccgaaggggaaggcgcctgggctttcaatacatcctcctgaatcatactgcgtttcaggttccttagaaaaatttggatgtgtaaaaagaactcttaacggcgatgcaggtcttccacagctaaggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttatagaaaacgagaaaaaagaaaaaaatgagaaacaagtaagaaaaaatcctttcctaggcttttccttgatcttcagaggcacacagggtttaatggttccttaggttattattttgaggttttgttctttcttttgccttaagtaatgacagaagatatatatggccagacacatatgtataaacttttcagcagcattttaataataaaatatcacactattttctaatgctttgtacaaacaattatgcatctgttctttcttggtaggtggaatattttatttacttttgccattctttgaatgcctttttctttgtaaatgctacatggtagctctcacataggctacaaatggataaatacatttggtaatgggatggtttctttagctttggccagctgcacagttgaggaggctctgctggcctgattttggaaaaccaagccctgtttggtgaagctcctgagatgacactgcctgaaaatgagtatttggttgtgttatttctaccactgttcattcttgtgtctctgtgttttgatttgtgttcaacaaactgatgccttaatggtttcaaatagaaagccttaggtgagtaaaccttctagtgacagtaagaaattctactgaatgaaactccagaggcagaaaatcattgtcattccaatgggagctcaattgtcaattccttcctgtgcattcagccatcacgaacttatttcacattcacagtagctctaaggggcaggcacctgcattactcccctttcataatggaagatgttctgactttgaaacatgcccccttggacaggaaaatttgatggataacaggatagcatatcctcatatcccaatctttcaccaagaagttatacagcaaacacttgtaagtcaaggtcttgcatgataatctttgctaagtagcaagtaaagaaatatagcaaggacccagactctttggaatatgtgaactaaatccttcagatgttgttggcctcaatcatgttgtgaaggcacacaggagaatacatacacacacatatgcatatatgtatatatgtacatgtatgtgtacattatatatgagtatacatgtacctatcctatatatgtatgtatgtatagagtcacagactgcataatgttttggacaaatatagatcacatatatgatgatagtgtcttgagattaaaataccatgtttttattgtaccttttcagtgttcagatatgtttagacaaacaaatgcttatcattgtgttacagttgcctaaggtcttctctccagtcacatgctgtacaggtttgtagactggaagaactaggctataccatagagcctaggtgtgctataggctacacatcggttttgtgtaagtatactacatgatgtttgcacaatgatgaaattgcctaacgaaacttttctcagaaacctattgatacatgactgtgtatgtttacattatatatactgtatatgcacacatgcatatatgcatatatatgttatacatttacatatgtacatggatatcacatactttaaattcctgaagatgtcattttcattaaatacatatgcacacacactcataaacacacacagactcatatatacacacaaatctataacacatttgtgctcacatatacattcctctgtgtgtgtgtgtgtattacattactgctttttatctgtgaaatcacattctgcagtttcatttactgtgatcaactatgatctaaaaatatatgagtacttcaataagatattttgaaagaaaccacattcacataacatttatgacattataattgttctattttattagctattgttcatctcttactccatctactttataaattaagcttcataataagtgtgtatatttaataaaatatatagtata

SEQ ID NO: 13953 - DNA, 5167 bp, Homo sapiens
  ENST00000355905
tttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatgatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttat

SEQ ID NO: 13954 - DNA, 5338 bp, Homo sapiens
  ENST00000382868
tttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagcacaaaacaccctggctcatggaaactgcaagcatcgttgtcagctgcacctgcaggcaccacgggattgcaagtcagcataccctttcagaaatgaggatgaaattagagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttat

SEQ ID NO: 13955 - DNA, 5460 bp, Homo sapiens
  ENST00000476359
tttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagcacaaaacaccctggctcatggaaactgcaagcatcgttgtcagctgcacctgcaggcaccacgggattgcaagtcagcataccctttcagaaatgaggatgaaattagagatggagtgttgctctgtcacccaggctgaagtgcagtggcatgatcttggctcactgcaacctctgcttcccaggttcaagcaattcttctgcctcagcatcctgagtagctgaaattacagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttat

SEQ ID NO: 13956 - DNA, 540 bp, Homo sapiens
  ENST00000481089
acagtcggaggcggcagagacggtggcgggtgagctaggggctgtgagacgaagcagggagagagtgaacttcagccccgtcccctccccactgccacggctggggcaacccaacccgcgcctgaagcggcttggcttgacctgcggaagcgcgggccgggatggcgtggggagagggaggttgcattggagttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaact

SEQ ID NO: 13957 - DNA, 5310 bp, Homo sapiens
  ENST00000339174
gagacgaagcagggagagagtgaacttcagccccgtcccctccccactgccacggctggggcaacccaacccgcgcctgaagcggcttggcttgacctgcggaagcgcgggccgggatggcgtggggagagggaggtaggtgccactgggctgcagatgacgagtgggttgggggcttgctgtgggacaagaggttcaggttccggcctgcgccttccactccgcggtggcgctctctgcctgcggttttccaggaggccgatctaccccagggacactctcatccttcaggcggtctcctggacgccctttcctccccttgcctcccagcctgacctggctctttcgcccctcggagaaccggttgcattggagttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatgatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatctta

SEQ ID NO: 13958 - DNA, 722 bp, Homo sapiens
  ENST00000413217
taaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactaggtatgcaagaggcacgtttgtgtgggagctcaaaaatgtttaattattttaaatctcctttcactaatttaataaattttttttgagttcagatgcaa

SEQ ID NO: 13959 - DNA, 8661 bp, Homo sapiens
  ENST00000380985
ggggctggtaggcgccggcgtggagctgccgcacgtgggagggcgctggccaggcagccactgtggcctctgcggctaggccggctcgagactcccgggcgcccaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaatgaactcatatttctttcatactttaacgttaaaaccgaaatgcatgagagcaaaagcaccatggtgttctttctatttagggcctacctctaatatttaaaatctaccaaagagcagtcacaaaattaaaactcagcccgggcgcagtggctcatgcctgtaatcccagcactttgggaggccaaggcaggaggatcacctgaggtcagagttcaagaccagcatggtcaacatggtgaaaccctgtctctacaaaaatacaaaaagctgggcatgatgttgggttcctgtagtcccagctacttaggaggctgaggcaggagaatagcttgaacccgggaggtggaggttgcagtgagctgagatcatgccattgcactccagcctggacgacagagtgagattcagtctcaaaaaaaattaatactcaaagaattatctagcataatttaaaagaaaggactttttaaaaattctctagcataattcaaaagaaaggacttaacttttttttttttagtgtggtcatccgtctagttgttctttttttccagatcagagcagagaatatcactgacatgcttgaaatggtggataactatgtaaattgtaattggacaaatgtacactttagatttatggactgagccacatataataaggtctctcctggtaattgatccaggggatttaggcctctttcgggttttttgttttttttttaggcattgttatgttgtgaaggataaaatcttcaacatcttatgcaaatggatagtaggcatgatcctaaaggtttagttttacgatgctgcagagaagagaaatgtcttgacgttttgccacctgatgtagactttgtccccctctagtataaatgttgcatgttacctagataaacaactaaaaattgccttgagttatcacctgagctacttatgccaaggtcttgcctttctaaagctaataaggtgagaggtggatatctgtagctcttcggatgaaaaattgcattgtgggagataccaaaattgaggaaatagctcttcaaagaaaaattactgatatgatcattgtacttgtaaatgccttaagtagcaggcagtgactcaattttctactttaccattttacctttagcttttatgtatgaattataggtctgtggagattctgcctccccactaggccagtgtgtgtttaccatttattcattttctatcatacacaggtggattaaaatttacattaaaatttacattaaaataccatcatacttcaggcttctataacaaaatatcagactgggtggcttcaaaagcagacatttcttacagttctggaagctgggaagtcccacaatccacatgctggtaaatttggttcgtggtgaggcccctcttcctcttttactgaccacatccccaaaagtgtcaggtagacatgttacaaatagctctgtagagagccatgggaagagacaggaggcagatgtggaacataaagggtttagaaacttctgcaggcagcagtggcagggagcaagccctagagtgtctctttttacgagagcaggaatcccatcatgagagttccttcctcatgactttatctaaacccagtcacccccaacaaaggccccaccccctaaccccatcacattggctgttacggcttcaatgtaggggatggggcacaaacattcagtccataacgaatactgattcctcaaatagggtttaaacatagttaactgagcccccaaagaatgttaaaagagaaaatccattttatttgaatagatgcagtgaccacagcttcttccctcaaatcaacacattacagttagatgtctcccatctgaaattggatagcccactgaaattgaacatgccttctcttataaatgtgtggtgagaataaaagcaacaaagaaatgaatgtggtggctcacacctgtaatcctaacactttggaaggttgaggcaggaggatcctttgtgctcaagagtttgagaccagcctgagcaacacagtgagaccctgtctctacaaaaactaaaaaaattagctagggatggtggcacatgcctgtagtcccagctacttgggaggctgaggtgggaggattgcttgagcccaagaaggtcaaggctgccatgagccataatcacgccactgcactccagcctgggtgacagagaccctgtcttaaaataaaataaaaaaaaaaggaaaaggaaagacatacataccctcagttcttcgaaaaacagtcaacgtccaaaaagtttattttttgagtcacctttaatagagaaatttcccactggaaacagatccacctaagtgattatctagtatcagctgtatcaaggcaaaaggtaaaggttataagatgtaaatattagaccaaaatagccttttttaacaaacacaataatgctgtacgtctgtaacaaaacaaaatttgaaaaattgaggtaatgtacacagcgatgcacacacccccacaccacaccgtgattcctgagttttgatttggttgaattcaccttgtagttccctttcctgagaaaatacaggttcaacacatctagtccacgatgtacgtacaaggggaaggggtgaacaggaaatagactcccttattctgctcacatgagctggaacctgtactagctgcatatttcatagaccccagaggctcacctcaattgtactcctatgataaaatgtctctagcatttgtcatgagagaaactggctagaaatagtttgttcattgcgtccagcaagacacgcattgctgttgatatctttgtggctaagatggagaatgtgactggataatagttatccaggtggattactagctattgaaacagtctgagatagttgcatgatgattaacgttaaactgggagtaatttcaagtcatttggctaaaaatgaaaaaaaagtcccataaaaaggtatcaaatgtacagataatagggctggaattattaagtatgatgatgttattaacatctaaaattattttggccgggcaaggtgggtcacgcctgtaatctcagcactttgggatgccaagatgggtggatcacctgagttcaggagttcaagaccagcttggccaacatggcgaaacccgtctctactaaagaatacaaaaattagccaggtgttgtggcacatgcctgtactcccagctactcaggaggctgaggcagaagaatcatttgaaccccggaggtggaggttgcagtgagccgacattgtgccgcttcattccagcctgggcaacagagtgaaactcttgtctcaaaagtaaaaaaataataatgtttaaaaatatttcaatgtggagacaagctcaaaatgaaattagacacattccattacccaggtaaaagaaggggaagcctgacttgatagtagtattcaggaaaaaagagttggcagttttatttggccaaattccaatatcagctcatggtacagcacaccgggggagggggacgggaggcgagaactaaggctttttaagaatgtgttgatggaagtatgtgcctagatcaaaagaataatccccccggactccagtgtaagatcaattactgttggaatattgtgttcctttctagatatcacattttaagcagactttggccaagtagtacagtgtttgcaggagcagtaacaagatggtgataactttgaaaatacttctcaaaagaaaaataaaaaagaattagggaagttcagtctggagataattcagaaatacagatgataattgttttcaaattcttgaaggaaatgggagagagaataggctaattctgtattgcttcagaaaccaaatggaaacaattaaattccattagagaaacggttggaaaatatgaggaggatttagttcagtacgaggaagctgtttctaatactttttgttggttaaaaatacattccgctgctgtggaaagcctgtagctgccaggagtgttacagagggcattcctcccttgagttgacatttgtgccaaaccggcttttagggcttctccagcttttaagatgcgataatgataagatgatcatcgggaaaacatccctcagatgaaacgttcacaggctggctctgaaaactggcattcagatgattgcggctcccccatactgtaggaatattgtttatggcttaaggttgcctcgctcctcatctgtaatcagtgaaagtttatccagaggttaattaccggttttctggtgggtatctgggaactgaggatgggagattaactgttgtatatgaccatagtaaagcaaaagactgttagagaatgagtaaacgttcgttttcctccctacagaatttacagttactctctgtccattccactcactactgtcttcatcacacacacagaggcaaacgtctgattcagatagccaggtgtgccatgcatgcactccaccatattgtgatctcttcgaggcttgtttctgtcccctgtcctccacagtcctggattgttaatgaatagttcatacatgtttgttaaataaatataccttctttaaaatta

SEQ ID NO: 13960 - DNA, 8354 bp, Homo sapiens
  ENST00000502464
ggccaggcagccactgtggcctctgcggctaggccggctcgagactcccgggcgcccaggcgctgccgcccgcctcgccgccccacgccgaaggaccacgcgcccgccgccgccagcctctcagcgctcccatgatcgcccggtgccttttggctgtgcgaagcctccgcagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaatgaactcatatttctttcatactttaacgttaaaaccgaaatgcatgagagcaaaagcaccatggtgttctttctatttagggcctacctctaatatttaaaatctaccaaagagcagtcacaaaattaaaactcagcccgggcgcagtggctcatgcctgtaatcccagcactttgggaggccaaggcaggaggatcacctgaggtcagagttcaagaccagcatggtcaacatggtgaaaccctgtctctacaaaaatacaaaaagctgggcatgatgttgggttcctgtagtcccagctacttaggaggctgaggcaggagaatagcttgaacccgggaggtggaggttgcagtgagctgagatcatgccattgcactccagcctggacgacagagtgagattcagtctcaaaaaaaattaatactcaaagaattatctagcataatttaaaagaaaggactttttaaaaattctctagcataattcaaaagaaaggacttaacttttttttttttagtgtggtcatccgtctagttgttctttttttccagatcagagcagagaatatcactgacatgcttgaaatggtggataactatgtaaattgtaattggacaaatgtacactttagatttatggactgagccacatataataaggtctctcctggtaattgatccaggggatttaggcctctttcgggttttttgttttttttttaggcattgttatgttgtgaaggataaaatcttcaacatcttatgcaaatggatagtaggcatgatcctaaaggtttagttttacgatgctgcagagaagagaaatgtcttgacgttttgccacctgatgtagactttgtccccctctagtataaatgttgcatgttacctagataaacaactaaaaattgccttgagttatcacctgagctacttatgccaaggtcttgcctttctaaagctaataaggtgagaggtggatatctgtagctcttcggatgaaaaattgcattgtgggagataccaaaattgaggaaatagctcttcaaagaaaaattactgatatgatcattgtacttgtaaatgccttaagtagcaggcagtgactcaattttctactttaccattttacctttagcttttatgtatgaattataggtctgtggagattctgcctccccactaggccagtgtgtgtttaccatttattcattttctatcatacacaggtggattaaaatttacattaaaatttacattaaaataccatcatacttcaggcttctataacaaaatatcagactgggtggcttcaaaagcagacatttcttacagttctggaagctgggaagtcccacaatccacatgctggtaaatttggttcgtggtgaggcccctcttcctcttttactgaccacatccccaaaagtgtcaggtagacatgttacaaatagctctgtagagagccatgggaagagacaggaggcagatgtggaacataaagggtttagaaacttctgcaggcagcagtggcagggagcaagccctagagtgtctctttttacgagagcaggaatcccatcatgagagttccttcctcatgactttatctaaacccagtcacccccaacaaaggccccaccccctaaccccatcacattggctgttacggcttcaatgtaggggatggggcacaaacattcagtccataacgaatactgattcctcaaatagggtttaaacatagttaactgagcccccaaagaatgttaaaagagaaaatccattttatttgaatagatgcagtgaccacagcttcttccctcaaatcaacacattacagttagatgtctcccatctgaaattggatagcccactgaaattgaacatgccttctcttataaatgtgtggtgagaataaaagcaacaaagaaatgaatgtggtggctcacacctgtaatcctaacactttggaaggttgaggcaggaggatcctttgtgctcaagagtttgagaccagcctgagcaacacagtgagaccctgtctctacaaaaactaaaaaaattagctagggatggtggcacatgcctgtagtcccagctacttgggaggctgaggtgggaggattgcttgagcccaagaaggtcaaggctgccatgagccataatcacgccactgcactccagcctgggtgacagagaccctgtcttaaaataaaataaaaaaaaaaggaaaaggaaagacatacataccctcagttcttcgaaaaacagtcaacgtccaaaaagtttattttttgagtcacctttaatagagaaatttcccactggaaacagatccacctaagtgattatctagtatcagctgtatcaaggcaaaaggtaaaggttataagatgtaaatattagaccaaaatagccttttttaacaaacacaataatgctgtacgtctgtaacaaaacaaaatttgaaaaattgaggtaatgtacacagcgatgcacacacccccacaccacaccgtgattcctgagttttgatttggttgaattcaccttgtagttccctttcctgagaaaatacaggttcaacacatctagtccacgatgtacgtacaaggggaaggggtgaacaggaaatagactcccttattctgctcacatgagctggaacctgtactagctgcatatttcatagaccccagaggctcacctcaattgtactcctatgataaaatgtctctagcatttgtcatgagagaaactggctagaaatagtttgttcattgcgtccagcaagacacgcattgctgttgatatctttgtggctaagatggagaatgtgactggataatagttatccaggtggattactagctattgaaacagtctgagatagttgcatgatgattaacgttaaactgggagtaatttcaagtcatttggctaaaaatgaaaaaaaagtcccataaaaaggtatcaaatgtacagataatagggctggaattattaagtatgatgatgttattaacatctaaaattattttggccgggcaaggtgggtcacgcctgtaatctcagcactttgggatgccaagatgggtggatcacctgagttcaggagttcaagaccagcttggccaacatggcgaaacccgtctctactaaagaatacaaaaattagccaggtgttgtggcacatgcctgtactcccagctactcaggaggctgaggcagaagaatcatttgaaccccggaggtggaggttgcagtgagccgacattgtgccgcttcattccagcctgggcaacagagtgaaactcttgtctcaaaagtaaaaaaataataatgtttaaaaatatttcaatgtggagacaagctcaaaatgaaattagacacattccattacccaggtaaaagaaggggaagcctgacttgatagtagtattcaggaaaaaagagttggcagttttatttggccaaattccaatatcagctcatggtacagcacaccgggggagggggacgggaggcgagaactaaggctttttaagaatgtgttgatggaagtatgtgcctagatcaaaagaataatccccccggactccagtgtaagatcaattactgttggaatattgtgttcctttctagatatcacattttaagcagactttggccaagtagtacagtgtttgcaggagcagtaacaagatggtgataactttgaaaatacttctcaaaagaaaaataaaaaagaattagggaagttcagtctggagataattcagaaatacagatgataattgttttcaaattcttgaaggaaatgggagagagaataggctaattctgtattgcttcagaaaccaaatggaaacaattaaattccattagagaaacggttggaaaatatgaggaggatttagttcagtacgaggaagctgtttctaatactttttgttggttaaaaatacattccgctgctgtggaaagcctgtagctgccaggagtgttacagagggcattcctcccttgagttgacatttgtgccaaaccggcttttagggcttctccagcttttaagatgcgataatgataagatgatcatcgggaaaacatccctcagatgaaacgttcacaggctggctctgaaaactggcattcagatgattgcggctcccccatactgtaggaatattgtttatggcttaaggttgcctcgctcctcatctgtaatcagtgaaagtttatccagaggttaattaccggttttctggtgggtatctgggaactgaggatgggagattaactgttgtatatgaccatagtaaagcaaaagactgttagagaatgagtaaacgttcgttttcctccctacagaatttacagttactctctgtccattccactcactactgtcttcatcacacacacagaggcaaacgtctgattcagatagccaggtgtgccatgcatgcactccaccatattgtgatctcttcgaggcttgtttctgtcccctgtcctccacagtcctggattgttaatgaatagttcatacatgtttgttaaataaatataccttctttaaaatta

SEQ ID NO: 13961 - DNA, 564 bp, Homo sapiens
  ENST00000514991
aggcagccactgtggcctctgcggctaggccggctcgagactcccgggcgcccaggcgctgccgcccgcctcgccgccccacgccgaaggaccacgcgcccgccgccgccagcctctcagcgctcccatgatcgcccggtgccttttggctgtgcgaagcctccgcagatggagtctcgctctgttgcctaggctggtgtgcagtggcgtgatcttggctcactgcagcctctgcctccctggttcaagcgattctcctgcttcagccacctgaagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagc

SEQ ID NO: 13962 - DNA, 2637 bp, Homo sapiens
  ENST00000506539
gtggcctctgcggctaggccggctcgagactcccgggcgcccaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacaggtgagttttttttttcccccagtaaacctgccaattagtttttttagaaaacttcttgactgctgtcaggtttctgctcctaacaggttttttcagaagctgaatgtgttcaagaattttataggccttctgcaaaaccaaaattttccttatcctgtcctctttcacaacatatttttacttggaggttcatctaccagtgaaagatgtttgttgaataacagcctatggaaaaagaataagactatctgtaaggaaaggttacaaatactttgctttttccttttaatcctttaggaatttgatataaatttctcagaaaaactgtgctgtaatctgtctcttctgcttatcaatgctttgtttactttagtggtttttcaatcctcttagaccctttactcatttttaaataataattttgtaacatttgcctttactaacttcaaattaaaatcatagataatatagtctaaccatgcaaagaatttgccagagtggaggtgtatgtgtgcagtagattaaaactgatttttttatttctgaaaataaaaagtacatttattctcaactttgtaatacagtccatttaattaggcccagactattctagcatgaaccatatgaacttgctaacatttaaccattattaacatatgaaaatgtctagttcagcaattcaccgtaatagttgaaatatactgttatttggctgggcatggtggctcatgcctgtaatcccagcactttgggaggccaaggtggaaggatcgcttgagtctaggagtttgagaacagcctgggcaacgtggtaaaacaaacaaaaattatccaggcatggtggtatgtgcctgtggtcccagctactcgggaggctgaggtgggaggatcacttgagttcaggaggttgaggttgtagtgagccatgattgtgccactgcaccacagcctgggtgacagagcagaccttgacttaaaaaaaaaaaaaagaaaa

SEQ ID NO: 13963 - DNA, 2085 bp, Homo sapiens
  ENST00000506799
ttaatttcaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcat

SEQ ID NO: 13964 - DNA, 701 bp, Homo sapiens
  ENST00000506677
gttagccaggctggtcttggactcttgacctcaaatgatccacccaccttagcctcccaaattgctgggattacaggtgtgggccaccgtgcctggcaaaaaatgagtttctttttattgctaatgccctgtatttttatcttcctttcaggaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctaggttagttcttttttttttttctatgactgttttgctataccatgtcaaccagacagaaggcctcagaacataatatgcctttgaggacatcctacttttccttcatttgagagaagtatattgatcacctattaagtgttagatagtgtg

SEQ ID NO: 13965 - DNA, 1658 bp, Homo sapiens
  ENST00000511299
aaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcac

SEQ ID NO: 13966 - DNA, 1106 bp, Homo sapiens
  ENST00000509935
ggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagagacttctaaacatcatggaatctccttgatcatgtttcactattcaaagggagaggtggatcttgttcctttttgaagtaggagccaggctagccagtgttcccttctcctctaggagccatacacttgatggacataaaacattgcagagaaaacagaagccctttcttctaaaaagattacaactcatatttgcttcaaataagacctgaaatagctgctcactcctaaaagagtatctgaactttatgggaaaagaagagcaccatcaagtaggcaaccattcctggggagaagttgatttggctatcaggttaaataaacatcttt

SEQ ID NO: 13967 - DNA, 617 bp, Homo sapiens
  ENST00000507201
ggagctagggagaaattgcttgtttaatggatctcttcatttttaatggaaaattctttaaaaatacttctgctttcaaagcttaaggcttgtttttagcttagactgattgtatttttcagttctggttttctgatgattgttccaactttgtctacaattcaaaggaatgaaattactactgtaatatagagtatttgggggttgtttttcacactgttcagctgctgtgttttattttcacttgactatgaggttattctaacccctcattcagaggaacaactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagct

SEQ ID NO: 13968 - DNA, 720 bp, Homo sapiens
  ENST00000515595
ggtgagcttgtcaggtgcctgatcgtcatcccccgtccttggctggtcgctctctgccctgatgactgccgctcagtgtaggaaggagacagctctggctgccctccccagagtcatccatgctgggaaggatggaggaggggtggaaagttagtgagagcctgcatgtgctgctgcagagatgcccaagatagcaggagacccaatctgtttcccatttatatattctcattgctgatagatgatggacatccttcatttaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttt

SEQ ID NO: 13969 - DNA, 708 bp, Homo sapiens
  ENST00000505678
tcccttgggtcctctctgttacagaagttctgatttttcctagcgagctggaggaaagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcg

SEQ ID NO: 13970 - DNA, 754 bp, Homo sapiens
  ENST00000512422
ctctgttacagaagttctgatttttcctagcgagctggaggaaaggcagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtc

SEQ ID NO: 13971 - DNA, 6483 bp, Homo sapiens
  ENST00000264663
gatttttcctagcgagctggaggaaaggcaggtacccggagtggagttatattacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatgtgcacatatacaccatggaatactatgcagccataaaaaaggatgagttcatgtcctttgtagggacatggataaagctggaaaccatcattctgagcaaactattgcaaggacagaaaaccaaacactgcatgttctcactcataggtgggaattgaacaatgagaacacttggacacaaggtggggaacaccacacaccagggcctgtcatggggtggggggagtggggagggatagcattaggagatatacctaatgtaaatgatgagttaatgggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgta

SEQ ID NO: 13972 - DNA, 4310 bp, Homo sapiens
  ENST00000344920
cgaggtgggagcggagctgcagtcacgtggccgcccgccgccgcggagttggggctgttcttccgggttggaggcgcagcgccgcggggcccaagcccgggtctgccagcgcgacgtcctctcgcggccctcagggcacagcccaaggctgtcagcctcccggcccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggc

SEQ ID NO: 13973 - DNA, 4288 bp, Homo sapiens
  ENST00000512996
ggcgcagcgccgcggggcccaagcccgggtctgccagcgcgacgtcctctcgcggccctcagggcacagcccaaggctgtcagcctcccggcccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttt

SEQ ID NO: 13974 - DNA, 747 bp, Homo sapiens
  ENST00000515208
aaatccaaggggcaaaggaagtgctggcttctgatttggtggtcaaagtaattattcctttttcctctcccatttacagcatgctgactttttgaaatcttttcatagaaaaattaaattactttatctggagttacaccttttcctattttcaaacagtgtatttttctcaaagaaatgactgcatgtcgtcatattcttcatgctccagtaaaacttttatcagacaatatgatctatgtttaaccatgaggagagaaaaagtgatcttcatttttacatttgctatatggacattttcttttaattggctaggaaaaatttgttctacatggtccatatatatccagagtacccacacgtgaacatttactgctagaatggaaagaaggtatggaacttagtctgggactaaatgttcagtgatcttctgacacctgaaggcgcaatgacttacactgacatacgtgctatttctagagagggcatgactattttggagaaagcagctttgggctgagtggcgagtagctttacctactctaaaataagttcttaaggtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatg

SEQ ID NO: 13975 - DNA, 367 bp, Homo sapiens
  ENST00000506893
agatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtgaggataccatttaccagggtttagtcttgattgtttgattttgcaagttatatatatatatatctatagatatatgtgtagctatatatacgtatatatagatatatatacacatatatatctacacatctatctatctatctctctctctc

SEQ ID NO: 13976 - DNA, 682 bp, Homo sapiens
  ENST00000503651
gatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcagatgaagacagagagggttgataattttacctatgaagacactgaagcacagagaggttaagtaacttgcctgagatgacacagctagggagcagcagaaccaggattcaaaccagactgacttaagaaaacatattcttattcacaaccctatgcaacttctctaatttttaactggaagacaaaatagtgttgtatctaactctctcaccagatggttaatgggctatgcactggaactttggatacatgatatgtgggtaggaaaataaattaaaactacagtcatattgaatgatttaatgtaaaattaatgtcaatccctagatattccagtggtgccacttccaaagtaatagtttacatcaaggaaaaaggtaccttattcaggaaagttaacttctagttccctggtcacccactgtcattttctttttactgaccactaggtaacactttcttctgttgcagaacaactgtccacatgtttgctatcaaggaaggcgataattaaagatgtatgttcaga

SEQ ID NO: 13977 - DNA, 664 bp, Homo sapiens
  ENST00000513390
ccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggtaagcacttgtgggcttctgccttcatgtgaactccagtttctcaatatatatttctaaggtccatattgatgaaataattaaattttgttcatggaagttgcttcagttaatattattttggtgaaaattcattccagttggtgtaattctcattcaaatacattttagaacactgaataaatgcatcaactgagtcaaaatatcctatactcaattcttatcttcctttactgactgtgtcccgttagctgataatggaatgggggattggaatccttatgtatgtactatacataagctaacttttgttctgctgggtataaataacagccaaagattctgcttcatagacctgttaaaaatg

SEQ ID NO: 13978 - DNA, 634 bp, Homo sapiens
  ENST00000503059
tgctcactgagcaaggcaaaaaagtcagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaacta

SEQ ID NO: 13979 - DNA, 579 bp, Homo sapiens
  ENST00000565560
gcttctgggtcgcgctcagctctgcaatgcatgcgttctgtgatcctgccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagc

SEQ ID NO: 13980 - DNA, 642 bp, Homo sapiens
  ENST00000563439
gccgcagctgctgcacccacccccaccctgcccggccctttctgcaccgtcatctcctgccccgccgaggcttgacccgtgctgtccccctctcccttcctttgcccaccgattggagggacactctggaaaactcagttgaagaaagcggagagtctgcgtgtacacagtgcaatgatgtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccc

SEQ ID NO: 13981 - DNA, 578 bp, Homo sapiens
  ENST00000568086
agctgctgcacccacccccaccctgcccggccctttctgcaccgtcatctcctgccccgccgaggcttgacccgtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcatagtgagttctccgatccctggctggtggagggaagctgggaagggcctggctgtccagggtggtgggaggaggctagagtagccagaccagatattttgggttgtctctgatgggcagtggggtgtgggggggaggtagataggtatttaggatggaattctgctagacaggaaaatatagttcagttcctcatagttca

SEQ ID NO: 13982 - DNA, 677 bp, Homo sapiens
  ENST00000564992
tgcccggccctttctgcaccgtcatctcctgccccgccgaggcttgacccccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaag

SEQ ID NO: 13983 - DNA, 1592 bp, Homo sapiens
  ENST00000564053
gcaccgtcatctcctgccccgccgaggcttgacccgtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcataagagtagatgccagtcctgggaaaggcaggggaggagaggagagccacggctgacgcttggggacagaaggaggagcctgaggaggagacaggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagc

SEQ ID NO: 13984 - DNA, 519 bp, Homo sapiens
  ENST00000565645
accgtcatctcctgccccgccgaggcttgacccgtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcatagtggggaagcagatttgagagaaagaccttagtttggataaacggggtctgaactcgcctcggatttgccgggggtggagctcaggacgtcctggttggggagggcattcagagagtagatgccagtcctgggaaaggcaggggaggagaggagagccacggctgacgcttggggacaga

SEQ ID NO: 13985 - DNA, 613 bp, Homo sapiens
  ENST00000568199
atagttcagttcctcatagttcaggctggagcaagtaagattccagttttaccactgaatctctgagcctgtctcctcatctgtaaaatgggaacagcaatcctagcccagagggttgtcaaagtcactgtgctatcgggcctggcagaatgggagtgagaggggctcagagggactgttacaggacatgaggtgacgatggtggggtggcaaggcaggagctgatggagactcactgagaagtggagaagcaagattcatcacatacgggacataaagggagatggaggggcagggggtagtcctggtctcggcctggtggggaagggcttcaatgggaggaagccagggtgtgaagtgacgggggaggattgcttgaggccagcagttcgagaccagcctgatcaatatagcaagaccaggacaggcgcggtggctcacgcctgtaatcccagcactttgggaggccaaggcaggtggatcacgaggtcaggagttcaagaccagcctggccaacatagtgaaaccccgtctccactaaaataaataaatacaaaaaatatatatagcaagaccccacctctaaaaaaaaaaaaaaaaaaaaaggctgggc

SEQ ID NO: 13986 - DNA, 752 bp, Homo sapiens
  ENST00000566871
caggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctggg

SEQ ID NO: 13987 - DNA, 1511 bp, Homo sapiens
  ENST00000568503
gacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggtgagcgcgcggggcggggcctagggcagagcagggacggggctggggcagacaaaaggcccggggagggcagggttgtcgtctccgctagaagtaggcgagtgtgaaaccgcacaggggtaaattgagcctcagtcactcccacttccgccccaggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaa

SEQ ID NO: 13988 - DNA, 794 bp, Homo sapiens
  ENST00000563258
cgagttccccgtgttggcctccaggtcctgtgcttgcggagccgtccggcggctgggatcgaggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaa

SEQ ID NO: 13989 - DNA, 1351 bp, Homo sapiens
  ENST00000568146
ctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttcc

SEQ ID NO: 13990 - DNA, 317 bp, Homo sapiens
  ENST00000564860
agagctggaacccgaggctgaagcagaaccagagccggaactggagccagaaccggacccagagcccgagcccgacttcgaggaaagggacgagtccgaaggtattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagg

SEQ ID NO: 13991 - DNA, 1394 bp, Homo sapiens
  ENST00000268605
gccgcagctgctgcacccacccccaccctgcccggccctttctgcaccgtcatctcctgccccgccgaggcttgacccccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttcc

SEQ ID NO: 13992 - DNA, 12158 bp, Homo sapiens
  ENST00000317775
agagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggctcatgatgcctcagatctgatccgcatctaacaggctggcaatgaagatacccagagaatagttcacatctatcatgcgtcacttctagacacagccatcagacgcatctcctcccctttctgcctgaccttagggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagacactgctgaacctttcctctgggaccccctgtggccctcgctctgcctcctgtccttgtcgctgtgccctggtttccctcctcgggcttctcgcccctcagtggtttcctcggccctcctgggtttactccttgagttttcctgctgcgatgcaatgcttttctaatctgcagtggctcttacaaaactctgttcccactccctctcttgccgacaagggcaactcacgggtgcatgaaaccactggaacatggccgtcgctgtgggggtttttttctctggggttcccctggaaaggctgcaggaactaggcacaagctctctgagccagtccctcagccactgaagtccccctttctccttttttatgatgacattttggttgtgcgtgcctgtgtgtgtgtgtgtgtgtgtgtgtgtgtgtgtgatgggccaggtctctgtccgtcctcttccctgcacaagtgtgtcgatcttagattgccactgctttcattgaagaccctcaatgccaagaaacgtgtccctggcccatattaatccctcgtgtgtccataattagggtccacgcccatgtacctgaaacatttggaagccccataattgttctagttagaaagggttcagggcatggggagaggagtgggaaattgattaaaggggctgtctcccaatgaaagaggcattcccagaatttgctgcatttagattttgataccagtgagcagagccctcatgtgacatgaacccatccaatggattgtgcaaatcccctccccaaacccacccataccagctagaatcacttgactttgccacatccattgactgaccccctcctccagcaatagcatccaaggggcctggaagttatgttgttcaaagaagcctggtggcaataaggatcttcccactttgccactggatgactttggatgggtcacttgtcctcagtttttcctagtcataatgtcatacgaacctaaagaatatgaatggattaaatgttaaagctttggtgcctggaaacaatatcaagtaacaatatgattattatttttttattcccccaaagcgggcttgctgcttcacccttggggatgaaataatggaagctggttaaagtggatgaggttggaaagagttgccataatgaggtcccacgtggcttcttcgataggagccacaacttggggtgggaagaacttgtccctcaggcttgttgccctctgcagttgatctccaaagttttaaacctgttaaattaattttgacaaataagttaccctcaactcagatcaaaaatgggcagccaagtcttcggtaggaattggagccggtgtaattcctccctaagaggcaacctgttgaatttactctctcagagtaaatggtgggaagggatccctttgtatacttttttaaatactacaaattagtgtcaggcagttcccagaaagagacaagaaatcctagtggcctcccagactgcagggtccccaaggatggaaagggaatgttctgctggttctaccctgtttgttgtgtcttgctatacagaaaaaccacatttcttttatatactgtacgtgggcatatcttgttgttcagtttgggtgtctgctaaagaggaagtgcactggccctctttgaaagggctttacagtgggggcaccaagaccccaaagggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttcccactccaagtcaagctttatgcaggaatgcttttccatcagggaataaatacttagaagcgcttacaaggtgccaggcacctcctttctgcatgtgcctgcctttctagtagcagacagatggaaacattgtctcattttgtcaaggagtccaaagaaatgattataaaaccaggattcatccttcttctccagaaagatttttttttaagtaaacacctttcaatccccaacacaagctgcttcacaactccaggctagaaggcaggagagcgatctgatgtgtttctttcatttgccagaattcctgataccaaaagcctctctctctgttgagtaacctctcaaggaccagagtggagtccagattgttaggctcagatcaagggtggggaaatactgccctctcgtggtggcttttcatccaggcctcgtagccaaccgtttaagtgcaaaatagaattaagcaatgggtaagcaaaatagggttgacaagatatttgggggttattcgggttatggcccatttatttccctcttccccctgaattgaccagtagcagctccagccccatttcacaaaagtgagtttggccaggaggaatgagacgtctcctgaaataggaacaccggaacatcatgctcacctgccatcactatgcatccagttcccacagcttgtgtcgtgaaagagcagagagatgatgttaaactccttgggaggagagagggcttcttttggtttccctggagtgagacagccaggtgtctttcttttgcggggggacacttcagacccatcaatatggaattttgggagccgacctgagtgcaaatcctaattctgcccctgttggtgcagatggctgtgggcggctcacttgaccttttagagtctgcatacccacctgtataacaaggtggattgaatgagacaatgcccacgaaatgcccagttacagtacctggttcaaaacttactgcattttaatttttcacttaacttataacatgtcttgcttctccagtgtgtggaaggcaccgggcagtttgcagagataagcaaaacacagttcctctcgtgcagaaggttagaatctatttttttttttgacagagtcttgctctgtcacccaggctggcgtacagtggtacgatctcagctcactgcatcctctgcctcccccagttcaagtgattcttctgcctcggcctcctgagtaactgggactacaggcgcctaccaccacgcccagctaagttttgtatttttagtagagtcagggtttcaccatgttggccaggctggtcttgaattcctgacctcaaatgatccacgcacctcagcctcccaaagtgctggattacaggcatgagccaccacgcccagccaaaggttataatctgatggagagagacacccgtcttggaactgacataaatttctggggtttgagaaatgggcgggatttcactggtagcttctggaaggtaagagttgtccaggaattgggaagagtgagaggaaaggcacggacagggagcatgtaagataaattgaggctggctttggaaggctgaggagggtgagaaaaggtgggctgggaccagaccgtggggagaggtgagtggcattacaagaaatttaggctttattcagaaggcaacagggagtccctaagaatgtttttcaaaaagggacattaaggcgattggagttatacttggaaaagaaagttctggccacagtacagagcatggcccgttgagctgttgggggggttattgctgcaaccaaggcttgagtgagggaagaggcggatgtagtgataaagagactccaggaactgaatcagcgtacctggcaccccatccattgtagagggtgagaataaaggagaaattaaagcatcttgcaggctgggcgcggtagctcatgtctgtaatcccagcactttgggaggccgaggtgggtgtatcagttgaggtcaggagttggagaccagtcagccagttagtagaaaccctgactctactaagaaaatacaaaaattagctgggcatggtggcatgcgcctgtagtctcagctacctgggaggctgaggaaggaggatcgcttgagcccaggaggtggaggctgcagtgagccaagattgtaccactgcactccagcctgggtgacagagcaagactcttatctcaaaaaaaataaaataaaataaaataaaataaaacatcttgcccctagctgagagagaggtctctgaagagcaggctcagggaaaagatgagttttcagagctgatgtgatagtcagcttctctggagtcaacagggtgaatccttcccaagtccagccatgcccagatgcccggagggaaaactgacccccagccagtagacattggctaagaacacagaatcttctgaccaaacacgctttcagcagctgcctgctctggactttgaaagaggtcaggtcttgccctaagctcaaaacaagtgagaggtgtcctgacctagctcatagggcaaatggtcctaataggatgggcaatccagatgcctgagccccttcactccgacagcaccagcgcctaatgcagccttttcattcttgccattaggaaatctgtggacttctagcctgtgttttaaaccagccatgtttccttgtatatttccctacccgctgccccacatacccagcatgccgctgtggccaccatgtcctcaaagccttctgtctgtatcaggaatgtagtctgagactgccaggaagcaacaaggagagagaaacactaactagtcttcctttataacccattcatactctctggctgtccccaaccttcatagtctcctgcatccaaatgtcctctttggctcaaaaagtaggccaggcatggtggttcatgcctgtaatagcactttgggagactgaggtgggaggatcacttggggccaggagtttgagaccagcttgggcaacacagcgcaatctcgtctctactaaaaaaaaaaaaaaaaaaaaattagctgggcatgatggcatgctcctgtggtcccagctacttgggaggctgaggcaggaggatcacttggtcccaggagtttgaggcgacagtgagctaggatcgcaccactgcactccagcctgagtgacagagcaagaccctgtctctaaaaaaaattaaaatgaaagaccaggtgctgggattaaggaaacacaggtctgagggtctgagggaaggggcctgcctcccagggagtcaacatagatgttccccatgaacagggatttgactttggaggccaacctggcctggcctctgccctttatctcacactccctatccttggcccactgccagtccctgccttgtggcaaaggggccccaaaagaaaagctgcccttccccaaatgtaaggacccaggtacactttcacccgtggaaagcagtgtctgtcgagagtctgtttcctattaatacttatcaaagccatgtgcgagggaggtggtcagctgtcaatatgccttagtatgtttatatgagtttgttttgttctaaaatacccaaacagttctggtcaagcggggctatgcccgtctggcccaaaacacagtccgttattaacgagatggccctggcaggcgggaacaaatctgcctccatgcactgcttcctgtagtcttttagaaagtaactccaggacatcgaagtgcccagatttgactcctaagttctaggagactgtagcgcagggtctgtcaaccttagcactattggcatttggggctgggtaattctttcttgtgggggccgtcttgggtactgtaggaagctgagcagcattcctggcctccatccacaagatacctgtagcagtgtcctgccaacggtaacaatcaagtatgtcatcagacattgcccaatgtccccagggggcaacacccctctcttggacttcagggtcaagagaatctctgctggctaccccaggacttctcattatagatttcctggagcacgcagcagaaactttgcctagcccagtggttgtttccattatctgctgccaaagtgggatttgagggtgtccgggggagggggcatggggagggcagtatgctttcaaaaacccctcccaggccaggcgtggtggctcatgcctgtaatcacaggactttgggaggccgaggctggcagatcacttgaggctgggagttagagaccaacctggctaacatggcaaaacctcgtctctactaaaaatacaaaaatcagcccggcgtggtggcgggcatctgtaatcccatctactcgggaggctgaggcaggagaattacttgaacccaggaggcagaggctgcagtgagccgagatggcaccactgcactccagcttgttgacagaatgagaccctgtggaaaaaaaaaaaaaagccctcccatgccagaacagaggatggcagtctgtttcaataagacactgtgtccttggtgttggttctgattaagactcactgagatccagtgctcttgagctgggtctcagtcccctcccatgtcctgtgctctgccgccactgttttcattgttgtgttctcgttgtgattgttaagactcacactcctggctcagcagtggttttccagaaggcccaaagagcggtgccgggcaccccacgtcgcagtgtccgttccgggcttgggaagctggggaggtgggcagacctggtcgcatctcaccacacacacacacacacacacacacacacacgctgtcagaaactcggccgtcccccctacctctgagctctcaatgctgctaatctctgccaagtgtccctgtgctccagcaccttccttgaaggactgacgcccaccccacgctctttgcgaggttgtccaggctgtgtttgtcgcatgctcttcttctgtatagttctcatcttccaattttatgggattcaacaaaagcctattatgcttgtttgcattatggttacaatattaaaaagtggattcaa

SEQ ID NO: 13993 - DNA, 4462 bp, Homo sapiens
  ENST00000338101
ttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagtacccggaacccttgcgtttctttccccgtaaagggcctcccctccccaatggtgacacagaagtccacggtctggctgcagcccgtgacagccagcacaggagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagaca

SEQ ID NO: 13994 - DNA, 527 bp, Homo sapiens
  ENST00000549189
ctagggacaaatgcagaaattcgtccgtgaattcgtcgtgtgaatgcagaaatatacacggatgtgcacacaactacagctctccacactgagcatgtgatctgtgcccagattaatccccacaaccacacaattccattttatagatgtgaaggctgggtgcagagggatgaagtaactggcccaccccaagttcagaacccaaaactcatagccctcttggggccacacacagcatgatgggcttctaagtaccttggatttttaaaagccactttataaagtgcttttatgaaacaagatctcacctgacctggaaaaccagtgaggctgggactattcaactcattcgacagcagaataactgaagatggagaaacaggctatccggcaaatctgactggaactcccaggcccctcccttgaggagctgctgctgagagatggaagaactggcctcatctgtcctgctcatgatgcctcagatctgatccgcatctaacaggctggcaatgaagatacccaga

SEQ ID NO: 13995 - DNA, 476 bp, Homo sapiens
  ENST00000477584
ctcacggctcagtccctacatatttatgccgcgtttccagccgctgggtgaggagctacttagcgccgcggctcctccgaggggcggccgggcagcgagcagcggccgagcggacgggatgaagaaacggaggcaccaagatgctgaagcccttgaccgagtcacgtgtcagtaaatgacagaatcaggatttgaatcccatgcctgtgatcctgaaccatgacattcccctttaacccttccttccaacctctgcgacatcagcttatagactgttgaaggtgacaccgttctcttctgtgatttttatttcaggggttatttgcagagctctgttcagtaaagctgactcaggtggggatgtgtcccgcagtgtcgaggtagggtgtcctccaggggcttcccaggtgtgctggtgcaacacgagataaagaccaagccagttcaggtaacccccaggtagagtcactaaaaaa

SEQ ID NO: 13996 - DNA, 12283 bp, Homo sapiens
  ENST00000618760
ataaaagatgtatgctttggagcccagagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggctcatgatgcctcagatctgatccgcatctaacaggctggcaatgaagatacccagagaatagttcacatctatcatgcgtcacttctagacacagccatcagacgcatctcctcccctttctgcctgaccttagggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagtacccggaacccttgcgtttctttccccgtaaagggcctcccctccccaatggtgacacagaagtccacggtctggctgcagcccgtgacagccagcacaggagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagacactgctgaacctttcctctgggaccccctgtggccctcgctctgcctcctgtccttgtcgctgtgccctggtttccctcctcgggcttctcgcccctcagtggtttcctcggccctcctgggtttactccttgagttttcctgctgcgatgcaatgcttttctaatctgcagtggctcttacaaaactctgttcccactccctctcttgccgacaagggcaactcacgggtgcatgaaaccactggaacatggccgtcgctgtgggggtttttttctctggggttcccctggaaaggctgcaggaactaggcacaagctctctgagccagtccctcagccactgaagtccccctttctccttttttatgatgacattttggttgtgcgtgcctgtgtgtgtgtgtgtgtgtgtgtgtgtgtgtgtgatgggccaggtctctgtccgtcctcttccctgcacaagtgtgtcgatcttagattgccactgctttcattgaagaccctcaatgccaagaaacgtgtccctggcccatattaatccctcgtgtgtccataattagggtccacgcccatgtacctgaaacatttggaagccccataattgttctagttagaaagggttcagggcatggggagaggagtgggaaattgattaaaggggctgtctcccaatgaaagaggcattcccagaatttgctgcatttagattttgataccagtgagcagagccctcatgtgacatgaacccatccaatggattgtgcaaatcccctccccaaacccacccataccagctagaatcacttgactttgccacatccattgactgaccccctcctccagcaatagcatccaaggggcctggaagttatgttgttcaaagaagcctggtggcaataaggatcttcccactttgccactggatgactttggatgggtcacttgtcctcagtttttcctagtcataatgtcatacgaacctaaagaatatgaatggattaaatgttaaagctttggtgcctggaaacaatatcaagtaacaatatgattattatttttttattcccccaaagcgggcttgctgcttcacccttggggatgaaataatggaagctggttaaagtggatgaggttggaaagagttgccataatgaggtcccacgtggcttcttcgataggagccacaacttggggtgggaagaacttgtccctcaggcttgttgccctctgcagttgatctccaaagttttaaacctgttaaattaattttgacaaataagttaccctcaactcagatcaaaaatgggcagccaagtcttcggtaggaattggagccggtgtaattcctccctaagaggcaacctgttgaatttactctctcagagtaaatggtgggaagggatccctttgtatacttttttaaatactacaaattagtgtcaggcagttcccagaaagagacaagaaatcctagtggcctcccagactgcagggtccccaaggatggaaagggaatgttctgctggttctaccctgtttgttgtgtcttgctatacagaaaaaccacatttcttttatatactgtacgtgggcatatcttgttgttcagtttgggtgtctgctaaagaggaagtgcactggccctctttgaaagggctttacagtgggggcaccaagaccccaaagggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttcccactccaagtcaagctttatgcaggaatgcttttccatcagggaataaatacttagaagcgcttacaaggtgccaggcacctcctttctgcatgtgcctgcctttctagtagcagacagatggaaacattgtctcattttgtcaaggagtccaaagaaatgattataaaaccaggattcatccttcttctccagaaagatttttttttaagtaaacacctttcaatccccaacacaagctgcttcacaactccaggctagaaggcaggagagcgatctgatgtgtttctttcatttgccagaattcctgataccaaaagcctctctctctgttgagtaacctctcaaggaccagagtggagtccagattgttaggctcagatcaagggtggggaaatactgccctctcgtggtggcttttcatccaggcctcgtagccaaccgtttaagtgcaaaatagaattaagcaatgggtaagcaaaatagggttgacaagatatttgggggttattcgggttatggcccatttatttccctcttccccctgaattgaccagtagcagctccagccccatttcacaaaagtgagtttggccaggaggaatgagacgtctcctgaaataggaacaccggaacatcatgctcacctgccatcactatgcatccagttcccacagcttgtgtcgtgaaagagcagagagatgatgttaaactccttgggaggagagagggcttcttttggtttccctggagtgagacagccaggtgtctttcttttgcggggggacacttcagacccatcaatatggaattttgggagccgacctgagtgcaaatcctaattctgcccctgttggtgcagatggctgtgggcggctcacttgaccttttagagtctgcatacccacctgtataacaaggtggattgaatgagacaatgcccacgaaatgcccagttacagtacctggttcaaaacttactgcattttaatttttcacttaacttataacatgtcttgcttctccagtgtgtggaaggcaccgggcagtttgcagagataagcaaaacacagttcctctcgtgcagaaggttagaatctatttttttttttgacagagtcttgctctgtcacccaggctggcgtacagtggtacgatctcagctcactgcatcctctgcctcccccagttcaagtgattcttctgcctcggcctcctgagtaactgggactacaggcgcctaccaccacgcccagctaagttttgtatttttagtagagtcagggtttcaccatgttggccaggctggtcttgaattcctgacctcaaatgatccacgcacctcagcctcccaaagtgctggattacaggcatgagccaccacgcccagccaaaggttataatctgatggagagagacacccgtcttggaactgacataaatttctggggtttgagaaatgggcgggatttcactggtagcttctggaaggtaagagttgtccaggaattgggaagagtgagaggaaaggcacggacagggagcatgtaagataaattgaggctggctttggaaggctgaggagggtgagaaaaggtgggctgggaccagaccgtggggagaggtgagtggcattacaagaaatttaggctttattcagaaggcaacagggagtccctaagaatgtttttcaaaaagggacattaaggcgattggagttatacttggaaaagaaagttctggccacagtacagagcatggcccgttgagctgttgggggggttattgctgcaaccaaggcttgagtgagggaagaggcggatgtagtgataaagagactccaggaactgaatcagcgtacctggcaccccatccattgtagagggtgagaataaaggagaaattaaagcatcttgcaggctgggcgcggtagctcatgtctgtaatcccagcactttgggaggccgaggtgggtgtatcagttgaggtcaggagttggagaccagtcagccagttagtagaaaccctgactctactaagaaaatacaaaaattagctgggcatggtggcatgcgcctgtagtctcagctacctgggaggctgaggaaggaggatcgcttgagcccaggaggtggaggctgcagtgagccaagattgtaccactgcactccagcctgggtgacagagcaagactcttatctcaaaaaaaataaaataaaataaaataaaataaaacatcttgcccctagctgagagagaggtctctgaagagcaggctcagggaaaagatgagttttcagagctgatgtgatagtcagcttctctggagtcaacagggtgaatccttcccaagtccagccatgcccagatgcccggagggaaaactgacccccagccagtagacattggctaagaacacagaatcttctgaccaaacacgctttcagcagctgcctgctctggactttgaaagaggtcaggtcttgccctaagctcaaaacaagtgagaggtgtcctgacctagctcatagggcaaatggtcctaataggatgggcaatccagatgcctgagccccttcactccgacagcaccagcgcctaatgcagccttttcattcttgccattaggaaatctgtggacttctagcctgtgttttaaaccagccatgtttccttgtatatttccctacccgctgccccacatacccagcatgccgctgtggccaccatgtcctcaaagccttctgtctgtatcaggaatgtagtctgagactgccaggaagcaacaaggagagagaaacactaactagtcttcctttataacccattcatactctctggctgtccccaaccttcatagtctcctgcatccaaatgtcctctttggctcaaaaagtaggccaggcatggtggttcatgcctgtaatagcactttgggagactgaggtgggaggatcacttggggccaggagtttgagaccagcttgggcaacacagcgcaatctcgtctctactaaaaaaaaaaaaaaaaaaaaattagctgggcatgatggcatgctcctgtggtcccagctacttgggaggctgaggcaggaggatcacttggtcccaggagtttgaggcgacagtgagctaggatcgcaccactgcactccagcctgagtgacagagcaagaccctgtctctaaaaaaaattaaaatgaaagaccaggtgctgggattaaggaaacacaggtctgagggtctgagggaaggggcctgcctcccagggagtcaacatagatgttccccatgaacagggatttgactttggaggccaacctggcctggcctctgccctttatctcacactccctatccttggcccactgccagtccctgccttgtggcaaaggggccccaaaagaaaagctgcccttccccaaatgtaaggacccaggtacactttcacccgtggaaagcagtgtctgtcgagagtctgtttcctattaatacttatcaaagccatgtgcgagggaggtggtcagctgtcaatatgccttagtatgtttatatgagtttgttttgttctaaaatacccaaacagttctggtcaagcggggctatgcccgtctggcccaaaacacagtccgttattaacgagatggccctggcaggcgggaacaaatctgcctccatgcactgcttcctgtagtcttttagaaagtaactccaggacatcgaagtgcccagatttgactcctaagttctaggagactgtagcgcagggtctgtcaaccttagcactattggcatttggggctgggtaattctttcttgtgggggccgtcttgggtactgtaggaagctgagcagcattcctggcctccatccacaagatacctgtagcagtgtcctgccaacggtaacaatcaagtatgtcatcagacattgcccaatgtccccagggggcaacacccctctcttggacttcagggtcaagagaatctctgctggctaccccaggacttctcattatagatttcctggagcacgcagcagaaactttgcctagcccagtggttgtttccattatctgctgccaaagtgggatttgagggtgtccgggggagggggcatggggagggcagtatgctttcaaaaacccctcccaggccaggcgtggtggctcatgcctgtaatcacaggactttgggaggccgaggctggcagatcacttgaggctgggagttagagaccaacctggctaacatggcaaaacctcgtctctactaaaaatacaaaaatcagcccggcgtggtggcgggcatctgtaatcccatctactcgggaggctgaggcaggagaattacttgaacccaggaggcagaggctgcagtgagccgagatggcaccactgcactccagcttgttgacagaatgagaccctgtggaaaaaaaaaaaaaagccctcccatgccagaacagaggatggcagtctgtttcaataagacactgtgtccttggtgttggttctgattaagactcactgagatccagtgctcttgagctgggtctcagtcccctcccatgtcctgtgctctgccgccactgttttcattgttgtgttctcgttgtgattgttaagactcacactcctggctcagcagtggttttccagaaggcccaaagagcggtgccgggcaccccacgtcgcagtgtccgttccgggcttgggaagctggggaggtgggcagacctggtcgcatctcaccacacacacacacacacacacacacacacacgctgtcagaaactcggccgtcccccctacctctgagctctcaatgctgctaatctctgccaagtgtccctgtgctccagcaccttccttgaaggactgacgcccaccccacgctctttgcgaggttgtccaggctgtgtttgtcgcatgctcttcttctgtatagttctcatcttccaattttatgggattcaacaaaagcctattatgcttgtttgcattatggttacaatattaaaaagtggattc

SEQ ID NO: 13997 - DNA, 4340 bp, Homo sapiens
  ENST00000344089
gctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggctggccccaggcccccaggcaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaa

SEQ ID NO: 13998 - DNA, 9371 bp, Homo sapiens
  ENST00000277541
gcgcgtgtgcgtcccagccccgccggccagcgcaggaggccgccgcccgggcgcagagggcagccggtggggaggcatgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaatgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgccgctgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttctactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatctgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgccacgggggcacctgccaggaccgcgacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacatcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaatgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgatgtcaatgagtgcgactcacagccctgcctgcatggcggcacctgtcaggacggctgcggctcctacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacgaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagacttggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtga

SEQ ID NO: 13999 - DNA, 652 bp, Homo sapiens
  ENST00000494783
atcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagactcagtgcgagtgcagcgatttgaagttgactaatcctccttccttaaaggagaaaaaagtaaaagccgtctccagatagagtcggctggtgcaggagagaatttagcgatagtttgcaattctgattaatcgcgtagaaaatgaccttattttggagggcgggatggaggagagtgggtgaggaggcgcccggacgcggagccagtccgccgccccccggccaccagcctgctgcgtagccgctgcctgatgtccgggcacctgcccctggcccccgtgcccgcaggtgagaccgtggagccgcccccgccggcgcagctgcacttcat

SEQ ID NO: 14000 - DNA, 743 bp, Homo sapiens
  ENST00000491649
ccacgtggtggaccgcagaggcgtggcagactatgcctgcagctgtgccctgggcttctctgggcccctctgcctgacacccctggacaatgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggtagtgctgcccgctggccggggtgcacgagcccctccccggctgccaggcccagggggtgggaacggggcgcctggtgtaggggcagccctgggagggcccatggcggggagttgggaaggcgggatggcgagttccccagactgcgtgtggtgtcggggggacgcgtctggagcggggtgtgcgctgggaggaggcttgcacagggtccaggtgccagcc

SEQ ID NO: 14001 - DNA, 8666 bp, Homo sapiens
  ENST00000263388
gcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgcgatcaggacatcaatgactgtgaccccaacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccagaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggcggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttatttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagatgggacatgttccatagccttgctggggaagggcccactgccaactccctctgccccagccccacccttggccatctccctttgggaactagggggctgctggtgggaaatgggagccagggcagatgtatgcattcctttgtgtccctgtaaatgtgggactacaagaagaggagctgcctgagtggtactttctcttcctggtaatcctctggcccagcctcatggcagaatagaggtatttttaggctatttttgtaatatggcttctggtcaaaatccctgtgtagctgaattcccaagccctgcattgtacagccccccactcccctcaccacctaataaaggaatagttaacactcagtgttgttggtctgtgtctaggtaaggtggggagtggtggcagtgggacttctatctcccccacccagggctaacttgagctcccatcttggggtaaatacatttgacttgccagtctacttatgcttcctcttttggcagatgactaccgattggattagtggttgtcacctgacttaagctgagccaatcagattcttttgctcgagaactttctttaatggagaggctaagaaagttgtcagttggtggagctcttaaggtcacaatcagatttagaaatatcagtggccaattcgaggtggtgggcaaagagacaagcaaacagggcagaagaatgaagctaatattcagggagaatcagaaatgagagctcaaatggctccttgagggctgggggggttatctcggctcccagtgcagttatcaattccagttaattgagtgttcattccattgagatcaacaggtatttattaattgctttctaagtatctgatcatggttctgcatgaatttcacttttacttcatgctcctatgggttttggagataaccttggacccatgtaataaatacttctttacttgtgcca

SEQ ID NO: 14002 - DNA, 564 bp, Homo sapiens
  ENST00000595514
gcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcacc

SEQ ID NO: 14003 - DNA, 559 bp, Homo sapiens
  ENST00000597756
tcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggtgagccccagcccttggtccactgggtgtcagcagtggcacagtgccattgcaatccagcctgggcaacagagtgagactctctcaaaaaacaaaacaaaataaaaccccaaacattggattaaaatataa

SEQ ID NO: 14004 - DNA, 3858 bp, Homo sapiens
  ENST00000601011
gggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgc

SEQ ID NO: 14005 - DNA, 748 bp, Homo sapiens
  ENST00000600841
cggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccaggtaggtgtgggtggcggcctttggaggaggagtaggggcgtggcctctggagtagtaggggcgtggcgtctaggaggaggatgtggctttaggggagacatcgaagggaagggagtttctggaaaatgctgacatttccgccgggtgtggtagctcacacctgtaatcccagcacattgggaggccgaggcgggaggatcacttgaggccaggagttagagaccagcctgggcaacatggtgaaaccccgtctctactaaaaatataaaaattagccgggcgtagtggcagctgcctgtaatcccagctactcgggaggctgaggcaggagaatcacttgaacccgggaggcggaggttgcagtgagccatcacgccattgcactccagcctggcgactgagtgacactccgtctcaaaaaacaaagaaacaa

SEQ ID NO: 14006 - DNA, 558 bp, Homo sapiens
  ENST00000595045
tctgcccacctcggcctcccaaagtgctgggattacctactggtagtgcgctgaacatctgtgtgtgtccttttgtgctggggttctttgcgtcttcatgggtatgtccaggtgggtctgtgtcccactaagctgagtgggtccctctcttaccccactgaagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcc

SEQ ID NO: 14007 - DNA, 3303 bp, Homo sapiens
  ENST00000311034
gctatataaggcggcgtgaggcaggcgaggggggcagcgcagccgagcggagcccaggagagcagagagcgagcctgagcgagagacggggaagcacggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcctcgcctgcatctacactcgcaagggcgtcttcttcgctggtggcactcctctggcgggccccacggggcttctctcagctcaagagcttgaggacatcgtagcggcactacccggctttctgcttgtgttcacagccgaggggaaattgctctacctgtctgagagtgtgagcgagcatctgggccactccatggtggacctggttgcccagggtgacagcatctacgacatcattgacccagctgaccacctcactgtgcgccagcaactcaccctgccctctgccctggacactgatcgcctcttccgctgccgcttcaacacctccaagtccctcaggcgccagagtgcaggcaacaaactcgtgcttattcgaggccgattccatgctcacccacctggagcctactgggcaggaaatcccgtgttcacagctttctgtgcccctctggagccgagaccccgcccaggtcctggccctggccctggccctgcctcgctcttcctggccatgttccagagccgccatgctaaagacctggctctactggacatctccgagagtgtcctaatctacctgggctttgagcgcagtgaactgctttgtaaatcatggtatggactgctgcaccccgaggacctggcccacgcttctgctcaacactaccgcctgttggctgagagtggagatattcaggcagagatggtggtgaggctacaggccaagactggaggctgggcatggatttactgcctgttatactcagaaggtccagagggacccattactgccaataactacccaatcagtgacatggaagcctggagcctccgccagcagttgaactctgaagacacccaggcagcttatgtcctgggcactccgaccatgctgccctcattccctgaaaacattctttcccaggaagagtgctccagcactaacccactcttcaccgcagcactgggggctcccagaagcaccagcttccccagtgctcctgaactgagtgttgtctctgcatcagaagagcttccccgaccctccaaagaactggacttcagttacctgacattcccttctgggcctgagccttctctccaagcagaactaagcaaggatcttgtgtgcactccaccttacacgccccatcagccaggaggctgtgccttcctcttcagcctccatgagcccttccagacccatttgcccaccccatccagcactcttcaagaacagctgactccaagcactgcgaccttctctgatcagttgacgcccagcagtgcaaccttcccagatccactaactagcccactgcaaggccagttgactgaaacctcggtcagaagctatgaagaccagttgactccctgcacctccaccttcccagaccagctgcttcccagcacagccaccttcccagagcctctgggcagccctgcccatgaacagctgactcctcccagcacagcattccaagcacacctggacagccccagccaaaccttcccagagcaactgagccccaaccctaccaagacttactttgcccaggagggatgcagttttctctatgagaagttgcccccaagtcctagcagccctggtaatggggactgcacgctcttggccctagcccagctccggggccccctctctgtggatgtccccctggtgcccgaaggcctgctcacacctgaggcctctccagtcaagcagagtttcttccactactctgaaaaggagcagaatgagatagaccgtctcatccagcagattagccaattggctcagggcatggacagacccttctcagctgaggctggcactggcggactagagccacttggaggactggagcccctggactccaacctgtccctgtcaggggcaggcccccctgtgctcagcctggacctgaaaccctggaaatgccaggagctggacttcctggctgaccctgataacatgttcctggaagagacgcccgtggaagacatcttcatggatctctctaccccagatcccagtgaggaatggggctcaggggatcctgaggcagagggcccaggaggggccccatcgccttgcaacaacctgtccccagaagaccacagcttcctggaggacctggccacatatgaaaccgcctttgagacaggtgtctcagcattcccctatgatgggtttactgatgagttgcatcaactccagagccaagttcaagacagcttccatgaagatggaagtggaggggaaccaacgttttgaataagtctgtgacttaacgtcgtcaagtatggcatattgtcatcaagacgtggagccgctctccacccccccgggactgttggggggattctgagggccagagggggatatatatgattccccaggccctgcaggattttggggggggggaggtgggagggcaagggaggggagcttctttttaaaatcaagagacttcgagcgatcccagtttccatttcaatctgtattcactcgtagtgagtttccttgaatgggatttcaagcggagaatgggggagtctcacttccccgccgccttgccccattggcctgggccagttctccactcctaggggccaagccacccctagccttggtgggggaaaggcagggcccacccgggccagcccgtgccctgaggggctcttgacacccacgtagaattctctacacaccagtaacgggatttcaattccgatggactctgccgccctggcggcccttcctgtgacttttgcgccccgcgcctggggtggggggtgcgaagagacgctacgttcctttccgatggaggaaggcagacctgccgtcacacgtgtgcttgcacgagtgcgtgtacctggtgcgggactcacccggccgccagactgcctgggcctgcccagatggccacctcgtggtgctgcggtgactttgtagccaactttataataaagtccagtttgcctttttggta

SEQ ID NO: 14008 - DNA, 2454 bp, Homo sapiens
  ENST00000525148
ggggaagcacggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcctcgcctgcatctacactcgcaagggcgtcttcttcgctggtggcactcctctggcgggccccacggggcttctctcagctcaagagcttgaggacatcgtagcggcactacccggctttctgcttgtgttcacagccgaggggaaattgctctacctgtctgagagtgtgagcgagcatctgggccactccatggtggacctggttgcccagggtgacagcatctacgacatcattgacccagctgaccacctcactgtgcgccagcaactcaccctgccctctgccctggacactgatcgcctcttccgctgccgcttcaacacctccaagtccctcaggcgccagagtgcaggcaacaaactcgtgcttattcgaggccgattccatgctcacccacctggagcctactgggcaggaaatcccgtgttcacagctttctgtgcccctctggagccgagaccccgcccaggtcctggccctggccctggccctgcctcgctcttcctggccatgttccagagccgccatgctaaagacctggctctactggacatctccgagagtggctgagagtggagatattcaggcagagatggtggtgaggctacaggccaagactggaggctgggcatggatttactgcctgttatactcagaaggtccagagggacccattactgccaataactacccaatcagtgacatggaagcctggagcctccgccagcagttgaactctgaagacacccaggcagcttatgtcctgggcactccgaccatgctgccctcattccctgaaaacattctttcccaggaagagtgctccagcactaacccactcttcaccgcagcactgggggctcccagaagcaccagcttccccagtgctcctgaactgagtgttgtctctgcatcagaagagcttccccgaccctccaaagaactggacttcagttacctgacattcccttctgggcctgagccttctctccaagcagaactaagcaaggatcttgtgtgcactccaccttacacgccccatcagccaggaggctgtgccttcctcttcagcctccatgagcccttccagacccatttgcccaccccatccagcactcttcaagaacagctgactccaagcactgcgaccttctctgatcagttgacgcccagcagtgcaaccttcccagatccactaactagcccactgcaaggccagttgactgaaacctcggtcagaagctatgaagaccagttgactccctgcacctccaccttcccagaccagctgcttcccagcacagccaccttcccagagcctctgggcagccctgcccatgaacagctgactcctcccagcacagcattccaagcacacctggacagccccagccaaaccttcccagagcaactgagccccaaccctaccaagacttactttgcccaggagggatgcagttttctctatgagaagttgcccccaagtcctagcagccctggtaatggggactgcacgctcttggccctagcccagctccggggccccctctctgtggatgtccccctggtgcccgaaggcctgctcacacctgaggcctctccagtcaagcagagtttcttccactactctgaaaaggagcagaatgagatagaccgtctcatccagcagattagccaattggctcagggcatggacagacccttctcagctgaggctggcactggcggactagagccacttggaggactggagcccctggactccaacctgtccctgtcaggggcaggcccccctgtgctcagcctggacctgaaaccctggaaatgccaggagctggacttcctggctgaccctgataacatgttcctggaagagacgcccgtggaagacatcttcatggatctctctaccccagatcccagtgaggaatggggctcaggggatcctgaggcagagggcccaggaggggccccatcgccttgcaacaacctgtccccagaagaccacagcttcctggaggacctggccacatatgaaaccgcctttgagacaggtgtctcagcattcccctatgatgggtttactgatgagttgcatcaactccagagccaagttcaagacagcttccatgaagatggaagtggaggggaaccaacgttttgaataagtctgtgacttaacgtcgtcaagtatggcatattgtcatcaagacgtggagccgctctccac

SEQ ID NO: 14009 - DNA, 326 bp, Homo sapiens
  ENST00000524617
tggccatgttccagagccgccatgctaaagacctggctctactggacatctccgagagtggctgagagtggagatattcaggcagagatggtggtgaggctacaggccaagactggaggctgggcatggatttactgcctgttatactcagaaggtccagagggacccattactgccaataactacccaatcaggtaagccacaagccaggggactagggggcagctgaggtcgtcatggaggagacacaaatcagggaactgctctggatatggacgtcggacccttaccagctgcctcttctctcctctccagtgacatggaag

SEQ ID NO: 14010 - DNA, 878 bp, Homo sapiens
  ENST00000639555
gctatataaggcggcgtgaggcaggcgaggggggcagcgcagccgagcggagcccaggagagcagagagcgagcctgagcgagagacggggaagcacggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcctcgcctgcatctacactcgcaagggcgtcttcttcgctggtggcactcctctggcgggccccacggggcttctctcagctcaagagcttgaggacatcgtagcggcactacccggctttctgcttgtgttcacagccgaggggaaattgctctacctgtctgagagtgtgagcgagcatctgggccactccatggtggacctggttgcccagggtgacagcatctacgacatcattgacccagctgaccacctcactgtgcgccagcaactcaccctgccctctgccctggacactgatcgcctcttccgctgccgcttcaacacctccaagtccctcaggcgccagagtgcaggcaacaaactcgtgcttattcgaggccgattccatgctcacccacctggagcctactgggcaggaaatcccgtgttcacagctttctgtgcccctctggagccgagaccccgcccaggtcctggccctggccctggccctgcctcgctcttcctggccatgttccagagccgccatgctaaagacctggctctactggacatctccgagagtgga

SEQ ID NO: 14011 - DNA, 2144 bp, Homo sapiens
  ENST00000488424
gggcagttgggattctccgtacgcctcggaaacagcagcccaaacctcacaacgcagaaccacgagatagtggggattgcagagccctgcgcaagagaaggaaaattaagacgcagcggagcccaggaggtgcccgcacgcgggaaggactggcgtgcagacgaggcagggggaggtttgcactcggcgtggcgcgggtgagccgcgtgctctcgggcacccggccgccagttcggatgcttccgatcctcggggagccggggcgctgcgccggagtcacttcagcccatgttgttcaggtgacacccggggaagagcagactccagtgtgcaaaacgtttcggggtttccgggccagcggttccgggcgcgcctcgcgggcggcggcgcagaactacaacccccaggctccctggcgtggcggcacgtgggcccgagccgggcggccgcggatataaagcgcggcggcggctgccgggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttcta

SEQ ID NO: 14012 - DNA, 804 bp, Homo sapiens
  ENST00000460690
gcagacgaggcagggggaggtttgcactcggcgtggcgcgggtgagccgcgtgctctcgggcacccggccgccagttcggatgcttccgatcctcggggagccggggcgctgcgccggagtcacttcagcccatgttgttcaggtgacacccggggaagagcagactccagtgtgcaaaacgtttcggggtttccgggccagcggttccgggcgcgcctcgcgggcggcggcgcagaactacaacccccaggctccctggcgtggcggcacgtgggcccgagccgggcggccgcggatataaagcgcggcggcggctgccgggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggttttaagaaagactggcatcagctgtttctcaatgcatcagtcacttgttcgcagatcaaacagaagacatgtgattgcatgaatcggcaggatttacttcctgttacagaagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactga

SEQ ID NO: 14013 - DNA, 2369 bp, Homo sapiens
  ENST00000463899
ggccgcggatataaagcgcggcggcggctgccgggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagtcaaaccatcataagttggggaccatccgcacaacccaaagtagacggagtagctttagaagacagctgaaggcctggcacagtggctcacacctgtaatcccagcactttgggaggccaagtggtagctgtgcctagcagcccaggagaaagaggaagagcaaatggatgattggcttcacctaaaccaagagaaaggggtagtgaagggaggggtcgtgcaataaaactgctggtgagagttcaacaggctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggtaagtgccacccatcttctgctttgtctgctgctggagactgtaaagaaaatggaataccatcactttctctgagggttcaacaagaacactttttaatggtctgttgcaagcagagttctgtttcccttattaaccctcggggccaaccatataaaactgtgaagtaaacctagttggaaaatctttggcaaccttctccattttagcacatgcctaccccattttccattctttctctcctaaaccatcagcactccctccctttacttgcttcagctcattaaaattctactactgcattgaggttgatttcagcctaagtgcttggaggaaggcagtctaaatacagattttactaaattgtgaatgactgacagctctcccaagagtatttacaatttaaacagagtttattaacacaagtaagcctaaatggatggaggtttggataatatgacaaagtaaaattggggagcagtcgtggggagaaatacagtgaatttgagtagagaaaccgctccagagtctcttaaatcttctataacaaatgacaaatgccactatccactcttctgcaagagattggcccttgggccaattgaatctgcgttaatgcaggaaaatttttaagtttatttttggtagacctccctgctccctgtcagagtcctgcataattctgacaactcctccctctcccccaagcacctcttctgtgttatgcccctcattcttgcagggttctcaacccactctcttactccttcaaggacgtttctgtttgtttttccactttcgtgatttttgcacatttgtgtgctgccagtgctatgaactacctattattgttccatttttctaagcaatggtttcacaaaattgtgggtttggtgtgataattattatgttcctaaaatacattaaaataggtattgaactgttaaaattttagacaaactaaaagcttgatgtgtgtagtagtccccccttatctcagggggatatgttccaagatgaccagtggatgcctgaaattgcagataatacgaaaccctatatatactatgttttttcctgtacatgcatacctatggtaaagtttaatttataaattaggcatagtaagagataaacagtaactaataataaaatagaacaattataacaatatactgcaataaaagttatataactatg

SEQ ID NO: 14014 - DNA, 1536 bp, Homo sapiens
  ENST00000367555
gggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagttttgtatccagagatttatcaactttgttgtcaaactagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttcta

SEQ ID NO: 14015 - DNA, 585 bp, Homo sapiens
  ENST00000479721
ggagcggctgcacggacaagagcggaggcctggctatacctgctggaatggataaagtgagctttaaaagttgatcagaccgaagagattgaagtgagagaaccacaggaacaaagaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgc

SEQ ID NO: 14016 - DNA, 518 bp, Homo sapiens
  ENST00000471010
gaaggggaaactgaagcagaaagaggttacttaatgggctcaaggtcacctacctgagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagtgagtggctgcatgaggataaaaatgccctttggcaacagctgtattcagtgagcctcttccccagaggatacgccctccctgcttcctggtcagagccggggcttgaggtcagctggtgggaagatgagcagggcccccgggatcctggcttcttggagaagagccccctccctttctgtgcagaagggcagccaaactgctagacacacctgccacccagaggttccgctgggaaactgcttcttacctgtctacaaggccagtcccctcacagttacccgtctttgggctgaaagg

SEQ ID NO: 14017 - DNA, 2231 bp, Homo sapiens
  ENST00000367553
acttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaa

SEQ ID NO: 14018 - DNA, 359 bp, Homo sapiens
  ENST00000460179
tgttgatcagaatcgccagcaacagtttgctttcctttttggggtggatgagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttct

SEQ ID NO: 14019 - DNA, 745 bp, Homo sapiens
  ENST00000367552
ttccagacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagttttgtatccagagatttatcaactttgttgtcaaactagaaaactcaaaactcaaagtttcaaagaaccaaaggactcttcctctgggcaccacaaacttccccttcctccactga

SEQ ID NO: 14020 - DNA, 2461 bp, Homo sapiens
  ENST00000258317
ttccagacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttcta

SEQ ID NO: 14021 - DNA, 3027 bp, Homo sapiens
  ENST00000367554
gcagacgaggcagggggaggtttgcactcggcgtggcgcgggtgagccgcgtgctctcgggcacccggccgccagttcggatgcttccgatcctcggggagccggggcgctgcgccggagtcacttcagcccatgttgttcaggtgacacccggggaagagcagactccagtgtgcaaaacgtttcggggtttccgggccagcggttccgggcgcgcctcgcgggcggcggcgcagaactacaacccccaggctccctggcgtggcggcacgtgggcccgagccgggcggccgcggatataaagcgcggcggcggctgccgggcggagcggctgcacggacaagagcggaggcctggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagtgagtggctgcatgaggataaaaatgccctttggcaacagctgtattcagtgagcctcttccccagaggatacgccctccctgcttcctggtcagagccggggcttgaggtcagctggtgggaagatgagcagggcccccgggatcctggcttcttggagaagagccccctccctttctgtgcagaagggcagccaaactgctagacacacctgccacccagaggttccgctgggaaactgcttcttacctgtctacaaggccagtcccctcacagttacccgtctttgggctgaaaggctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttcta

SEQ ID NO: 14022 - DNA, 2376 bp, Homo sapiens
  ENST00000614468
ttccagacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttcta

SEQ ID NO: 14023 - DNA, 4236 bp, Homo sapiens
  ENST00000368680
ggttccctccggatagccggagacttgggccggccggacgccccttctggcacactccctggggcaggcgctcacgcacgctacaaacacacactcctctttcctccctcgcgcgccctctctcatccttcttcacgaagcgctcactcgcaccctttctctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagagacaattaaaatctttattccagtga

SEQ ID NO: 14024 - DNA, 473 bp, Homo sapiens
  ENST00000413826
tttgtctgtttgtttctttatgcactcctggtaactcacagaacagaaaagaggttggtgatgctcactgggaattaggcaatgaagggcaggggactgcccaggggcgcttcgccaccagcaggctaaaaagataagaaaatgggcttgaggcgggaggaggataaagtcccacagcctggacaggacttggagaaggcatcccattggatcccctgctttggaatgggcatcgtttaaatagtaaaatctccctgtgatataggggtgttattttctcccatcctcttccaaaatcccagtgcctcttgttcccttccccacagctcccacctccatgcccttcatatgcccaccccagccgacctctgtttgcccctacaggtgaacaccatcccagcatccttccacgacgggctcctgctctatatccaggcagtgacggagactctggcacatgggggaactgttac

SEQ ID NO: 14025 - DNA, 1706 bp, Homo sapiens
  ENST00000368677
aaaatgtccatatgtctgaagcttcatacttgaccttggggtctcagaaaagaattgaactttcttccttctgttttcccctgctccccggtatcctgctatgccctcaaccctgagcgtctctagagacctcactgcagtctggagggggaagtgcctaggggcgggcgctcacggtaggctgtgctgctcctctcttaccacccccaccgccaccctctgcccccagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaaggtagagggagaagcctctgccctccccaccttttggggtcctagagggagttacccttctcaagcagccaatgccactcccatccctaaggctctcatctgactggggaaagggcatgtgccactccccagcccatcctcttttttccctccagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagaga

SEQ ID NO: 14026 - DNA, 774 bp, Homo sapiens
  ENST00000509104
cttctttgcgtggcagcatggcagagggatgtgctgtgtacggaacctggccctggggagggatgttccagctgttccggccttctgcccttgctggcctctgctccataggactggtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcat

SEQ ID NO: 14027 - DNA, 2715 bp, Homo sapiens
  ENST00000434067
ttctttttttttttttttaatctgtgctgccataaacgcctgcccttctgcaaattcaggaaagatttaattgctgtggagcactaaatctcaatttccagtgtgtgtggattaccctgtttgtggaattaaattttatacagatgtctcttttgctcctggttagtggctctaattaaataaatggaaattctcgcaggaattagaagctcctacttaacagtgaagatttcgggatcacagtgcataatctgaatataaatgacccagaagctgaaacattacccataatcacattgacggttccagaaagagcgataaggagagtgctgttaagggaggcgagcgctgacgccagaagttgccatatccccagaaaccccagtttgccttttcaccgtcgcaagtgagaaccagagcgcgttaaaggcctcggagtaaaaaacgcagcgtctgggactgcggcacccgggttgagtcgggtgcaagtttctgccgaaagagggcgtcggtctgagactaaaagaaatttgtggacacggacgcctagtcaaatgaaagaccattttaacacattttcaatgtatttaaatgtgcgggacttaattgtcagaattctcccgcccagtgtagcccgttcacattgcaaatgacttggctgcagtaggcacagaaggtccagttccattttgacccgccccgccgcgcggcggactcccgcgatgctcctctggtcacggacttctccagagccgcttccctccggtctccaccgctgctgtggctatggccagtgggaggactgggtctccgaggcaggacctttcttggagtcgcggaaccccagcacagtgcctcgagcgctccagagaaggagcggttggatctttgagcactcaggttggaggggagcgtgtgtcgtacccgggggacctaccgggaacgttttgggaaagacagtccctttatttaggtacctggtttagcaaacaaagccccgaggacgctttggggatgctttccaagctttgtgacacctccagaagttgaaccattccctcgcctttgggagcaacaagtttcactttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctgcactgggaccttggtccttgttccctgaccttgcgccgagggaccaggaaggtcaggtgctcgccccgcgtcggtgcttcaggagggaatgtggccagaacgagaaagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctct

SEQ ID NO: 14028 - DNA, 1366 bp, Homo sapiens
  ENST00000506712
aggtccgcgatggagccatctgcactgggaccttggtccttgttccctgaccttgcgccgagggaccaggaaggtcaggtgctcgccccgcgtcggtgcttcaggagggaatgtggccagaacgagaaagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtaagtctggagacttaatttgctatgtatgtcatcacctctaacctcagtgtaatgtaagtttaaaacccaagtgtttctagggccttacattttggaattttacatttctttctctgatgtggtaaaacgcatgggaacagttcacaaactggcatctttcaggtcttccttcccttccagtcttctcttccacaatggtagaatgtttcttcctatttttacatctcttactataatctcttggctaggtcatgtttccacttttagagaaaatcaaaatatcaattagtaaatatcactcccttattcatctgtcacagcaagtctcgttctgatttttcaagtttgtggttactttccagctcctcagaaccaaagagataacatcctttaaacatctgaacatttacacattggcaaataagtgtaagatgtattacttatgagcagctttgtatataagtagagaagcaattggatgttctcataagtagcttacaaataggaaagctgttagaaataattgttttagagaataaggtagtgagggagaacaaagtgaatataggtccttca

SEQ ID NO: 14029 - DNA, 7344 bp, Homo sapiens
  ENST00000265074
acgcccaaataagaagccacctctaagcaaaatagtatatgtataaacggagggcgaatatatacaagtatatatatatgtatattacagacgcacaggtttacacccggtgaactttttctttttctttttcttttttttttaagaaaaactagtgacattgcagagaaggacgcttcctctctatcttttggcgcattagtgaagggggtattctattttgttaaagcgcccaagggggcgcagggaccttggagagaagagtggggaggaaagaggaagggtgggtggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctctagagctggaggacaggtttgtggttgaggacttctctgtccgatgtctacattcaggttctgacttcatatcttgaaaaaggatttcctccctgtctttttcagtgtctcataaacgctactctggattgttgtaaatattagtgagatgggaggatttacagaagaaaagcaagtcaaaaatatttcctttttgatgtaaaaaaaaaaagccctatttcgcactaacattttattttacaagtattttaatcttatattttggtattagaaaaatttgtctattttttcattttgaagattaaatgttgcttacattttaaaagcatgggtgaagtgtacaacaaaccaataatgataaaaaatacttctctttttctccctgtttccctttttcccttggccacagccaaatgctaattgctgctttaattacagagatgtgtaaatgtattcagattacaaactctacaggaatacatcaacattttaactcttttgcgtttttactgtttaactgttttaaatgcaagttattttagggtgacactccttccagttctggccagatcatgagtttcaagatcaagagtaaaaagttattagaattaaacagttttataaagggaggcagcccttttccctcaagaacaactttgttgagagttactacttgacagcaagcacagaaatgacaaatttaaaacttttacacatggcatttaccaaaattcccagtgattattttgtttaaaagagggaacctaaatatctactctattccctttcagttaactccacagaactttgtaggcatccatgaatacctgtaatagtgggttaggtgtggagataaggaatttggacaaagttgagtaagtttttactgggtatctgctttgcacccagtagtctgcaacatgagtttaaactcaggttactactttcacttatactttatggagaagatagacagtgagggaggaatgggaagctgtcatgagagtgcaccgtcttggaattacataactggggtctttcctcaataacattttgagcatctgaaaaatagtttaaaaaattgtcttaatatctattaaaaggcatgtctagtgaggaaacaggagagtctgagcaatcccttggtggcgatgaaggtggtagttcacacaagtaacagtggaggcaaaggtaagcgcaagctgcctgtcccagatgctggcccatgtgtgagtgcttccctggagaagtccgcttctgttgctcccacctgagtcacagttaacagattatttctgtgtgaggcacatttcccttctgttgtttaagaaatgggagctgggaggcagctgagagggcgtgataaaagaattaagtgtgatcaactgaaacaactatgttgtagttctccatgctggatgcaaaggaaaaagtgtcgaattccaaaaaggatggaagaagaaggcaagaagggcaaactccagaagttctagtgcaggaagagagtttgagaagtaaaatccaggcaagcaaagcgttgtaccacttgggactccccaaagtgaaacagcaaggaaggattgtgtccatcttacttacttgaattggagagcttgtttctctctcatttttatttttcaatgatgttttctttatattttagagatattcattttctcttatcttgtgcttgtaaaaagcatttacatttcaagtctatgtgcttattacaggggaaaaataatctacctggttgcagtctttgagtataaacatttctaacctttttaaaacttctatagcagcccattaacactaacatttttagagcaaatatattctattttaacttcaggtagaggaatagtcctaaacttaatatgatagctctagataagatcttagagataagtgagcatttagtattctaaaagtggcagaacaaatcatgaggtttctggatgctataccaatttaaaatcaattcttatgttaatattgattgcttatttacatgtcagtcatctactttttttctttgaaatctgcatatgggttacaaaaactctgttaggttttgaaaattccattaagttggaaaccttggttaaaaatgtaggtgcctggcccatggttaccctggattcaggtctctcatgattatatttggggatttacgttcctaactgctaagcaacatctttgacaactagtaattcatactctactagtagtcacatgtcatatagtaaaataaatagggctttagttcttaagtaattctataggattttaccctgaaatccagggtgttcagatttcaaaaaggataatttatcagtattttctcatccagtcaaacttcagctgacattgatacaggtcaaaatgcgtagatgctttttggtgttggaaataagtgtctgtcttatggtcatcattgtcttcttagatttttgggtaggggggccaggtagggggagactcagaaataaaagcgttccccagataacttcaatctggaaagaattttttgtatagagtccatctctccctcaagactgaccacaggtttcatgagaaggtccctgaaaacatcacatttctctgaagaaccatcaacttgtcttttcttgaaccacaggaatggttctacagaccctactataattcttcacatttcagaacccatgtttaatggagggaagagagaaatgcatgggaaaagaacacctccttttctcctttctcttaaattcaaagacgtttgctttggaatgccctcacttctccctattcacaggcttctaaaatcattaatttactcaaggcacatgtgccttctttgccccaaatgcatcactttccttttagttatggctgattttgggtgtgtgtgtgtaagacatgcagtcaacaatgagatgaaggccattgcatagatctcatgcagatagtgatggattcagaaagtaggttccagtggcgtcactaccttcttgtaagccagtatacactggctatttgtggaaatctctttgggagatcaaatagagtattatgccactgtgagtgtttataaactggaaggaacaagtacctgtgtttcttgggacacaaagcactcagatcctgagtggatgcagacatgagagtaaatgtcagcccaaattaggcccctcgacctacagacatttcatgggttttatttaatcacaccccatggtttggggctacatgaggaagttggtaatgagctgaatttcttattcagtggaaaaaactgaaactgtctaaaaacacgggatatattttagaggcaattgtggaagcggagagaatgagatgatggtgttcagagggaccagcttctttttcagttgtctttagaactcaagaataatcaataatttagtgccccttcaacagccatactcagcaagaagaatcagaagcttgatcctctaacagaaatagaagagggtagctttgcccattgccactgtctttactgccccttctgcccctccacccacatccacattcagcatcactccaaggatgtgtcagcatcttgcccatgcaggtagaaatttgtgagtaggcctccatacttcctcgggggaagaaagagaaactagtgctggttttaagaatgtagctggcttttcatcagaacccttatgctaacctgaccacacttgctctcggggaagttcaagcctgtgatgtgcataaactccaacaagcctggctttggtgttcagcatgcacattccataaatatctcttgcaggcataccccacagctagactgcaggattaaaataacttccaaaaggtgctggattggagtttgttcaaatttctcattaaccactaatgttaattcataccaaatgcaaagtattctaaaccagctgatgctgtcagtgttcaagttttaagtgacttcaaacacaatggaagtgtttcaatgggagccagatctcatgagtaaaaatccattttataatagctctgtgatatatcagtgggagatgattcataggggagagatttgaacaagcagaattaagtgttagcaaaaatgctgcattgctttgattcatgtttaaagacctaaatttctatgcacaaggaataaagggcctacttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactaccaaacagtacaaatctatcatgagtctggtagaaaagtaaaagtaaaagctgcacacgttacatactgtttattgttctaatgtacaactaactatttgcatataatgtgatttaatttattgctgttttgtgtagaaaaggagaactaatgactgtggatataacccatgttttgtataatatattttatttcttgtgcgaactggtcatttaaaatatctacttcatttgatgtttggatataaatgtgtatgtgtccttgtaaatgtttctatcaagcaagaatgccacgtactcagagtataacaatgtgttctcattaaaaaatacatcccacggaaa

SEQ ID NO: 14030 - DNA, 1753 bp, Homo sapiens
  ENST00000415167
ggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaac

SEQ ID NO: 14031 - DNA, 660 bp, Homo sapiens
  ENST00000507141
cgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagttttaggtcttatctgttggaatcccagtggaagaaaattctcttcttgatcattctactgcctgttaaccacacatgcaagctttctttccagtcatctttccaatatggttgtgccaaaatttttctcagtaggctgaggcaggaggattgcttgagtccaagagtttgaggctatggattgccctatttgaatagccactgcattccagcctgggcaacatagctagaccccatctcttacacaatattttttagttagttcagtattcagtataaatattatcattactttctaaatgatatttaaggttaagtcacataggcttctatgttgacatttccttttttccccctacctattttccttggagttaaaacagtctgtttttgtttatttgcttaatttcctatggatttataattaaataatcttctaattctt
